United States Patent 12,790,634 (MOST PROBABLE NUMBER ANALYSIS OF HETEROGENOUS POPULATIONS) - sequence listing, part 40

SEQ ID NO: 28 - DNA, 6930807 bp, unidentified (residues 1,732,703-3,465,404 of 6,930,807)
  source 1..6930807: mol_type = genomic DNA; note = Enterocloster sp000155435
gtcatcatggcagtgaacctggctgattccctggccctggccgaccggctgctgcgggtgggacggggcgggaccgtgcaggaatactgcagggatgaatttgcggccctgccggtgaatactccgtggctgtacctgtatcaggagggacaggggggtgggaggacggaggattgaggatagggatgggtcatgcttttggcatcatcccgcttaattcggccaggtatcctgtccatctgcgatagaccgccagaagcttttcgtataaggcgctggcgtccggatcaggcagggagaggtcctcagtccggtggatgtgcgggatgcggtcataaccatcccacaggccgcatccgttggctgccagggccgcggcgcctaaggatgcggcgttctggtcaatgttggttttcaggacaggaagatgatagatgtccgcaaatatctggcgccatacggcgcttttgctgccgccgccgcagatgagcatttccccggtgatatcggtctgggtcataaggatgtccagggtgcagcgcagggacatggcgatgccttccatggacgcccgcaccaggtcctccctggtggtgctgagggataatcccatgaacccgcctttcaggtcgggagatggctcctgggcgctgccgccggccagggtggggttgaacatgaccccgttgctgcccgggggaacgctttcagccatgcggttcatggcctcataggtgtcggtgtcatcccctaaatccctgcacaggttatcccggatccagcggaaggaattgcctgcggagaagatggagacggcacatgtatagtaccccttcctggcatgggcaaatacaaagggctttgtatccctgtccacaatgggcctggaggaggtcacggcaatccagctggaggaacccagggaagtataggcaaccccttcctttaatccgcgtgcgcctagggccatgcaggtgttgtcaaccgcgccgcaggcaaccggggtgccttctgccagtccggtcatccgggccgcctccggggtgacggttccgatgatggcatcgctggggcggatttcagggaacagttccggacggattcctgccgcctccatgtattccggctcataatcccattttaaaaggttaaacaccccgaatcccgatgcgtaggaggggtccgtacacatggtgccggtgagcatgtaattgatgaagtccttggaccccaggattttgtgaatctgacggtacaggacgggctggtgcttcttcatccacatcagcttggcgacggtgtaacattcagccgggtccccgttgcctgtggtcatgtaccagctgtcataatccagccttgaaaacagttcctctgcctcttcctttgcccgcatgtcacaccagatgggcacctggtcagccagaaggctgccgcggctgtccaggggcacggccaccaggctgtggccggaaagggcgacacaggcaatgtccgacgcaggtgagccggacgtcacaagcagcttttttgtggcggcgcagacatggtcccaccagtccatgggacgctgctccacaaaatgttcctgcggaaaatacgttttgtactggatgaacacgtcggccagtgagtccccgtcctctgaaaacagggaggccttgatgcctccggtccccaggtcataagcaatcagctttttcatatgaaaatccccctatcttacagaacagaatataaaaaatcattagtgatttcatctgccggatacagccctacctgttcccctgcctttaaaagcaggatgcggtcgcacataccgatcagctctgagaaatccgaggaaatcagaatgatggaggcgccccgggccagcagcgcgttgtatatattgtaaagctcgcttttggacgtcaggtccaggttgctggacggctcgtcaaatatgtagagcttggcgtcctgatacagggagcgggcaatcagcaccttctgcatctcaccctggcttaactggtccacgggaacacggcaggagggcttgcgtatgctcagcctgtccatataatcccgggcatacagatccagggtatggccggaaatcatgtaaaaccgggcggccttctgcacgttggaggaggtgatgttaaaggtaaggtccttgccggagaacagcgagcggtccccgcagtctccgggcaggatgctgaccgcaccggcccggtccagggcaggggcatataccaggcggccggaggtaatgggacgttccttcatgatggcattgatgagggtggtgcggccggagccgactaccccggcaatgccaaggatttccccttcctggagggtaaatgagacatccttgatgatgccgctggatatgtggctggctgtcaggagcggctgtcccggcgtccttggcagcttcggatatgaaaagttcttcttaaaggtcaggacccgtctgacaaaggcctcatcccccagttcggcccgggagtaggactcggcaatccttccctgttccaccagtgaaatgcggtcgcaataacggattaccgtggaatactcatgggaaataaggatgatgcagatgttcttctgcttcagcccggtcaaaaggctcatgatccgctttgtctctaacacagtgagggaggcggagaactcatccataataaggatactgggcctgcataacaggatccgtccaatctgaagcaggcatttctcaccctgggacagatggtccacggactgtcccaggtccaggtccagcccaagttccttaaggacctggcggcatacggcttccttcttttccctgggcggattaaacagccggttgtggaaaataagctgctcgatgcccagcaggaggttgtccatgatgcttttaccgggaaagagctggagggattcggtcatgagatagatgccgttcctgtgggcggaagatatgctgtgtatgtccagcttcctgtcatccagccatatgtccccggatatacggggaatcatgcccgccaggaccttggccagggtggtcttgccctcgccgttgcttccgataatggcagtaatctccccggacgcagcctcaaagtccatatggctttccggaaacgggcctgcacaaacatttgtcatacgaactacgaatttatccataaacagtcctcatgaagtttataagtttaacggctttaaatcataggaggtaaatgtccgtattccatgttcaatgtaatactggtgatattccggcggaatgtggttgttggtcaccacggtggacgtataggtcaaatcccccagacggataaaggaacgctggtcaaacttcttgctgtcaatacacatgacggtttcattgcagcggcttgatatggccttgatgatgtctaagacattcatgtccgtcagggtgtatcctccttctatgctggccgcatccacggaaaagaagaatttgctcagatagatgtgttccagttccttgttcaggtcctcgggcaccgtatacatgccggaattctgcatccgcccgccaaggaacagcagctggaccgaggtattgcctccgaagatattggcaacatgaaagttattggtcatgatattcaggttctggcgcctggaaagcgcctttgcgatgtaactgctggtggtgccggggccgaggaaaatccattccctttccttaaccagctgggaggctgccagacccacctcttccttttccttatcgtaagggatggcagggctgtccgtgtgcacggactggaactgctgttctggaaatacctctgtatttaaggtggctcctccgtggtaacgggtgaggaagccgcttttttctaattgttctaaatcattccggatggttacttcggttacatttaaaagagtgctgagagtggcgacatctatctgtttgcgctcgaagatgatttctttaatacggtgtagacgttctgccttaaacattcatgcccctccctttcaaaacatttttcactataaagataacataagaaacgaaaaatttcaacaaaaaaagaaaaataaaaacaaaagaaaacgaaaaataaaaaaagaaaaagaaagaaaaagccttgaaaaacgaaaacacatatgctataatgacgaaaacgaagaaaggaaaaagactttctttaacgatttggccaaatcagcatcgtttttgttaaaaatttaactgactgggcgcgagggggatttccgcagatgtccggggataaaaagaaagagagggttatcatgaaaaaaacattagcagttcttatggcattgacaatggcagcttccatggctggctgcaacgcgggaagccagcccgcggccggggatgcaggggcaaagactgaggcggcttcatccgtccaggagaaatccgggacagaggataaaggaggttcagggacagaaggacaggacggggcaggagccggaagagaaaccggaacagaagccggaagaaagtacaggattggttttgccaacgcctccatatccaacagctggcgcgtaaagatgcgtgacatgctggtggatgaatgcgaccgcctgggggtggagctgatagaaaccgatgcccatgatgatgccaacacccagaacagtaatatagaagccatgctccagcaggacctggatgcaatcctgatcacaccctgtgttgaggatgcggccaatccaggtattgaggctgcatttgaaaccggaatcccggtcatcatctttgaccgtacatgtaccacggaggattacacacattttgtgggatattcggataagcagaacggcgcggagtgcgcaaggatgctggtggaagccctgacggagcgctacggggagccaaaggggaatctcattgcgctggacaccatggctggttccagtacggacaacttccagaaggaaggacaggactccgtattttcacagtatcccggtatcaagatcattgcaaggcagtatacggattttgaggtcagcaagggcaagagcttcatggaagactgcctggccaaattcggccccggggaaatcgacggattcatctcacaggacggcggcgtgacattgggagccgtggatgccatcaaggaggcgggacgcgaccaggaaggcatcattttcacaaatgcagatggtattaacggcgttgtgaagatgattaaggacggaagctgcgtgggcctgacccagttcccatgtgcggccagcgtggacgcccttcacgtggccattgactgtatcgagggaaaaggtcctgaggaaaaggatgtgatgatggattccatcgtggtcacaaaggacaatgtggacgattatctgattcccgacggggacgattacgactggacttattaaatggaactggatgctaagagcatatggatcagaacatgtggatcagaacatatgaattaccgcatagggggtacatagatgaagattggattttgtgttgtgaattattcggaaaagccgctggaggaagtccttaagattgcggcggacaatggctatgactgcgtggagctgccggcctatgtgggaaacggccaggtggatgcagaggacattttaaagaaccacaggacaggggaactgaagaaaatggtggagggttacggcctgagcattgcttccctgagtaatcatgcggactccccgctgatcatggggccttacagtgacgggactgtctcttcctgcaaggggacaagggaggagaaaatccgtttcggcacagaaagcatgatacgctccgcacagctggctgcggagctgggggttccggcggtggttgcattttccggcatggagaactacgggcatatcaatgactggccggagcctgatggatggaagtacgaagaggagcagtttgcggtaaaatggggcagggtcatggataagtaccgggaatacggtatcaaggttgcatttgaaccacatcccaacaacgtggtttacgatacccagtcagccctgcgcctgctggaggtggtggattaccatccggcatttgcaatcaacctggacccggccaatatcctgttctcaggagtgaacatccagacatttgtggatgaactgagaggacggatagccctggtccatgcaaaggactgtgaaattgtgtaccacaacctggcgaagggcgggcttaacatgtacatgcaggacgggtggggccgtctggaccgctccttccgtttccgcataccgggatggggcgacgtggactggaagcgcctgatcagcgaactgttcatcacaggatatgacggtgtgtttaactatgagcatgaggatgtgatcatgagccgcggggacggcgtgaagaaaaccattgagttcctgcgtccgctgatgattgacgcgccctacgagggccgcagcgacgcgctgttcacaaaataaaggagaagattatcatgaggaaaatgagggcacaggttcttacaagaccatatcactatgaattttcagaagtaccggtaccggagatatcggatgacgaagtactgattaagattaaatactgcgggatctgcggttccgactggggttcctatacagggaaatatgcggacgaggtggcgtgcctgcccctgattacgggccacgaattctatggcaccattgaggaagtgggggctggcgcccaggggttaaagccaggggacagggtgacctgcgatatctgtaagccctgcggcacctgttatcactgccggattggggaaccccttctgtgtacggattttaagcagattgggatccatgtggacggcgggttcgcagaatatgtaaaggtgccgtggaagaatgtgtatgtggtcccggacggggtgtcggatgaaaaggctgcatttgtagaaccgcttacggcctgtcttaacgcatccaggaaaatggactgcgtcatgggaaggagcgtggtggtcatcggcgcgggcctcggcatcatccatgcctgtcttgcgaagctgcggggcgcggcgcctgtgattgtcattgacggcaatcaggaccgccttatgatggccagggaaatggtggcggaccatgtcattaacttcaaggagaccccggacgtggtgggggaggtcatgaagctgaccaacggcgtgggggccgactttgttctggaagcagtggggaactccaaaacatatgagcaggctttccagatggtcagaagaggcggaaaggtggaggcattcggaatctgtgcggatgacgactacgccagcctgccgccggtgcaattcgtgctggaggaaaagaaggtcagcggaagctgcgccggaatcggatatgactggggcgatgcgctgacactgcttaaatatggccgtatcgatcccatgcccctgatttccatgattgttcccctggaggaactggaggatgcggtcaatgaaatccgcaagaacccgaaactggtcaaagttctggtaagccctgaggcgaaagaacgggtcatactttataaataagcctataagggggacattacgaacatgaaagaaaaaagtggatccggaatggtgaagaggatactgaataatccggtcagcggtccgtacatagcgctgatcatcctgttggtaattgcaagcatcatatcacctatctttccgacatttaaaaatattaccaatatacttcggcaggcatccattgtcggtgtggtcagcatcggtatgaccatggtgctgctggtgggagggattgacctttccgttacaagtaccatggcaattgcggcctgcgtgatggcaaggatgatggaaccgtatgtggcagcaggcggaaccggcgtttacataggacctgtcctgctggtgatgttctttggatttgtcatcggactggttaacggcagtatcattgtatgcaggggcgtggaggccttcatcatcacccttggcacgggccaggtgttaaagggcctgaactatatctataccaacggggcgccgggaggctcggtttccaagttctggtccacctttggttccaagtccctggggggagtcatcccctacgcggtggtgctttatgcggtcatcatggtcatattcatgatactgctccacaagaccgtatttggacggcatatctacgccatcggcagcaattccgaggctgccaggctctccggcgtaaaggtgaagttccacaaaatcatggcatacgggctttgcggcctgaccgcggccattgcaggcgtgatgctggctgccagggtccgggtaggcgagcccaacggcagcaccgggtatgacatggacgccattgccgcggttgtcatcggcggcacctccatggcaggagggcgcggttccctgatctgtaccctggcaggcgtgctgatcatggcggtgatgaataatatcctgaacctgctgggagtgaatccttatcttcagattgtcattaagggtctcattattctggtggcagtattgattcagaagaaaaacaaataatccgaggtgagcatatgagcgaatacgcattggaaatgcttgacgttaccaagacattttccaaagtgaccgccttaaatcatgtggacctgaaggtaaaggaaggagagatacacgctctcatcggagagaatggcgcaggaaaatcaacccttatgaaggttctggctggcgtttaccaggcagatagtgggactgtacgcatttttgggaaggaaatgcatttccacaagcctcaggatgccatcgataaggggattgccatcatctaccaggagctgagcctgatcccggatttaaatgcggttgagaatctgatgcttggacatgagattcacaaaaaccagtttattaaaaagaaagaggaggaagcgtttgcaaaaaaatggctggactatgtaagcgcgggcaccatcccggattaccatgttccggtgaggaacctaagcgttgcccagcagcagatgatagatattgcaaaagcggtttcctatcatgcaaaaatcattgtcatggacgaacccacggacagcctgacccagaaagagattgacgtgctgtttgaaattgtccggaagctgaagcaggacaatattacggtgatttacatatcccacaggctggaggaactgtttgaaatctgcgacaggattacggtactgagggacggggcatttgtggactgcgccaacattgcggatgtggataaggactggctcatcggaaaaatgattgggcgggatctgaaagacacgttcccgccgcgccacagggtcctgccgcaggaagtggtattagaggcaaaggacttgggcggggagcatttccacaatgtatccttttcccttcacaaaggggaaatcctgggcttttcggggctggtgggcgctggaaggaccgaggtcatgcgggccatattcggggcggacaaggtacattccggggagcttaagctctttgggaagaccgtgcacatcacccacccatgccaggccgtggaactcggcatgggattcgccacagaggacaggaaggcccaggggctgttcctgaaccagacaatcaaggataacattgccatcgcctccccaaaacgtgtgtcctccaacgggttcatgaaggggaaagaggagacaaggctggcaaaccagtacatgcaggaactaaaaatcgcggcgccggatatattcaaggtctgcaaattcctctcaggaggcaaccagcagaaggtggtcttatccaaatggctggcatcccaatgcaggatactgatcctggacgagccgaccaggggaatcgatgtgggggcaaagtatgagatttacctgttaatggataaactggcaaacgccggggttagcatcatcatgatttcctcggaaatgcctgaaatcatggctgtctcggaccgcatcatggtcatgcatgaagggacggtgaccggggagctttcctttgaggagtatacggaggagaatatcatgaagctggccagcggtgagaagcaggccgggcgggagtgaagatgtttggatgaaatcataaaaaggagaatttgatgtatgggatataaagagacattattgcagcccattaagattggaggcagggagtgcaggaaccggttttttgcccagcccatggagtgtgtggactcggatgcagagggcaatcccacggacctgacctatgagcggtatgagaacctgtacaagggcgggttcggcctggtggacctggaggccataacagtaaccaatgaaagcagggccaggaagacgcagctggaaatcatgccccgcaacgaaaaggccctggagaaattcatacgcaggatgaaggaaataaacccggacaccatgattgtgttccagctgacccattccggggaaatcagcgagcctgaattttccagaagggtttgcgtgaagccggtccatgggctggagggggatatcctgacagaagaggaagtggaccacatcatggaccagtttgccctggcagcaaaaatctgccagaacgtgggcgcggacggcgtggacatgaagctgtgccacggatacctgggttcccagatcatccgcccctataatgacagggactggaaatacgggggctcttgggagaggcgttccgcattcgcctatgacctgatggagcggatccagaaagcggttaactatgacaggaacttccttatcggttccaagatgtccatgtgggaggggttccctggaggattcggttcagccggcccggattccccactgatggacatgacggagccaatagacctgattcagggcctggagaagatgggggcatcctattttgtggaatcattgggcaatgtccactgcagcatgagtttcatggaggcagctaccaatgatccatacttttcctatctgcacatttactttgcggacctgatgaagaaggccctgaagcctgagactgttgtcatcggttcccatttctcctccttccgcggagggaagaacaagctgctgtccattgaaccggagaaatcctccctctttgcaatgggcgccagatgcattgaggacggcatgatggatatggtgggcctgggacgccagtcctttgctgatcccctgaccccgttaaagctgatggagggccgggaaaatgaaatcaaatactgtacccagtgcatgaactgcgaggaactgatgatacgccagcagccggtgggatgcgtggcattcaacaagccatatacacagaggtttgtggagatacgcaagaagatgggcaagcttacggagctgcatacctgaggaacgttataaaaattcacatagaaagaaaggcaaagaaaatgaaagagtacagaaaagacgtattgacagtaaaggatatcgcttacatgatggaccccagcgttttgaagctggacaccacaatccgggatgttgaggccatggtcgaggcatgcaggaaatatgacttcggttcctgcttctgctggccatgctattatccgcagctggtggagatgttaaagggcaccaacacggcgtttggaacctcccttgcattcccatccggccaggaatccacagagaccaaggtgtatctggcccatgatttcatgaagctgaacccggtggaaaatgatatggtcatgaatgtgggatggctgaaggccggactgtatgacaaggtcctggaggacatcaaggcggtcagggaagcaaccagggggacctccctgaaagtgattattgaagcaatggttctgacggatgaggagattgtaaaggcatgcgagctgtgtattgaaggcggcgcggactatgttaagaccggaaccggattttccaaagagcctaccagcctccatcacgtggaacttattaaggcaacggtaggggaccgtgcaaaggtaaaggttgcagggggcgtccgggatttgaacactctcttaaagatgtataaaagaggcgcgtgcagattcggcatcggacttagctctgctgtgaagattattgaggaggccattgcgctggggcatgatattgatatgtctacggtagagtgatggggctgtggcggagtgatgggtctgcggtggaatgatgggtcctgcgatggaatgatgggtctgcggtggaatgatatatccacgacaggccgatgatcggtaaaaactgatggtgacagatgcggacagatagagatggatgaagatgaatgaaaatgccgcctgtgcggcattttcaggtaaggagaataggaatatgggaaaacttacaggtaagactgcgctgattacaggcgcttcacggggaattggggaagggattgtaaaaatttttgcaaaacatggggctaggctgattcttttagatgtgtccccggaagccaaaacactggcggaagaactaaaatcccagggatatccctgcgcggcggtccaggctgatgtgcgtgatgctgcccaggtggcggcggctgttgcggagggaacgcagcagatgggggaaatcgatatactggtcaataatgcaggcgtgtgcaggcttggtaacttcctggaaatgagtgacgcggacagggatttccatattgacatcaatataaaaggggtatggaatgtgacaaaagccgtacttcccggaatggtgaaacggggagacggaaggattgtcatcatgtcttccgtgaccggggacatggtagcggacccgggggagacagcctacgccctttccaaagcagccctggtgggatttaccaagtcccttgctgtggaattcgccggctccggcatccgtgtcaacgccatctgtccgggttatgtgcgtactcccatggctgagagcattgcccgtcagtcagatcctgagaatccggaatccgttctgactgaaatggcaaaggcaatccccatgagacggctggccgcacccacagaggtgggggaactggcagccttcctggcatcggatgaatccagctatctgacaggtacccagtccgtcatcgacggaggaagcacactgccggaaagcgtcagcgtaggagtttaactgtatgatactatcaaagggcatcgtgtttataatggccctgttcctggttgccggcggtttggataaaatcgccggcaaccgtcttggattgggacaggaatttgaaaatggtttccacgccctggggccgcttgccttaaccatggcgggcatcaccagtctgtccccgctgctggccggatggctgtccggcgtggtggggcctttggctgcaaaagcagggattaaccctgccatggccccggccctcctgataccggttgatactggatgttatccgctggcccatgccatgacaacggatgggctggcagccgacttcgcggccctgatagtggcgtccatgctggcagccagcgtgaccttcagcgttccggtggcattgaccattatcagaaaagaagactacggatccatggcaatgggcaccatggcgggccttattgcactgcctgccggctgtctggccggaggcctgctgctgggactgcctgtgggcatactgttgcttaacctgctgcccgtaatcctggctgccctggttctggccgccggattgttctggttcccagatcagacaatccgcttctttgtactgtttggaagaggtgtggtagtggtcattaccctggcattgataacagccgccgcacaggaaatgacagggataacggttgtaaaagggatggcgcctttaaaagactcctttgtcatccttgggagcattgccgtcatgctgtccggcgcatatcccatgatggcggtgatccgcagatatctgaagggtcctcttggcagggcgggaagatacctgggtgtcaatgaaactgctatggccggattcctctccaccctggctaataatgttccaatgatggcaatggtgaaggacatggatgaacggggcaaggtgcttaacttcgcatttgccacctgcgctgcatttacattgggcgaccatctgggattttgttccgcggttgcgccggaacggattggggccatggtgtgcggaaaactggccggaggcgtgctggcggtgggagtggctttgtggctggtaagggggaagcggggagagtaagaaaacaagggaaagtaagaaaaacagggggaagaggtatgttgggtgggctggcccctgcagtggacgggtttctgcagcggatgggttcctgcagtggacgggtttctgtagcggacaggcccctgcagcggattggtccctgtggcggcctgtgaaggtggaactgattatccatccccggagatttggtaaaacgttgaacatgacaatgctccgggattttttgatattatggaggaaagcagttctattgattgatgaaatacaattagccggatacaatcagccaggtacaatcagccggatatgagcagctatgaatatggatactatgagtggccgggaccgtttttctctaatttttaagtgagcgcaatgaaagaaaaatcccgcgctgtacagtcattgacagccagctatgtgtgcagtggatttatttagcggtcctaaatacgtaacaataaaagataaaaaccacggagccggaaggatttaagtcccttctggctctattatcccttttgtcctgcggtccatccaaaatttaaaatgcagtataattaaaagcaggtgccaggtgttttgatgccctgctttttatgtatgtatttgaccagcaggatacgccgccaattccctggcaaaaaaatgtgagtgacagaaggactcctgcttcaggagtagtataaactaacctgcattttctctaaaaaccaggtattgcatgtctccgcaccctattttataatgaagtagtatgtcttaaccgcctataggcaggacgggaaggattatttatgaaaatatgcattgacatgaaccactgagatgttgatgtatggtgaataatgaaaagctggaaattaagaaagccggatgctgtttaaaggagcggaacatcaaataccagcggctggcttaaagggaagggcatgaggatagggaactattaaggggaaggtaacaggtatcagtgtgaaacaggccgtgggcggactggagggtcatgttggctgttgattgaaaagataagggcgtgctggtaaaacaatccggtctaaactaaaccaatccagttcaatatagccaatccagcattatccaatccagagcattatccagtccagcattatccaacccagccaggtccaatccagccaggtcaacccagccataagtaccaccttggcccatggatataagaataaaagagggggtaatcccgtggagatacttcgtgtggctgtctgtgatgatgacagggtatatctggagcagattgaagaggaaataaaagcatatattgaggggctgccaggagccatggatctgcagataagcctgtttaccgatagctgcagattatatgaggcggggattaagcagccttttgacctggcgtttctcgacattgagatgccggggaaggatggtttctggctggcaggacagctgggggccagctgccctgaaaccaggcttatatttgtatccagccatgagagctgggtttttgactcccatgagtatatgcctctttggtttgtgaggaagggacttttaaagcgggatatgaaccgggcgctgcagaaatattttcaggtgacggcccgcaggaaaatcagttataaaatccagggcggctttggggcgggggaggtgcttttgcgggatatcttgtacatagaatgcaatggccacacattgacatacaggatgtccggcggcgcagagtactctgtctatgggagcctgaagcctgtggaggaggaactgaaggcgtatggttttatccgtatccaccggaattatctggtgaatcagtcccatgtttcccagatagggaaaatggacgctgtccttaaaaatggtatggttgttccagtgggaagggacagaagaaaaggggtaaaggagatgatgatggaatatggaaggaagcgcggcagccagttatgtgattgatgtattgtccaccatcatggctgtggaatatatggaccatggttttgaaaagaaatattccggcgctgcccgaatcatgctgtttgcaggcggatgtactgcctattatggaatcatggccctgctcaaccgtcatgcggcttttgaagggggcctgggaatcagttatggggtggtgctggcagcctatggcttcattgcactgaatgggaaaatgcaaaggatccttgtccacagctttctatgggtattggtagccatcagcagttcctacatgatgtatggggcaatggggattatcacgggcagtagtcttaatacgctgctggtcatggaccggagggctgttgtgtttccgatgctggcgggatgcgcccttaaattctccatgggacgggcagccctggctttgtacggacagaaaaaggggatgggacaggcagaggatggaatgctggcaggtacatttttctgcatgtttatactgattctgggaatgtttcttctggaggaaggcagactggaccagagggggagatattttttatccctttgtatgctggcgggaatcttaggggtgatagttcttattggaagcttttatcaccgtctggagcaataccggagggaacagtgtgagacggaattcagaagggaaaccagattccagcaggaggaacagataaaggatttatacagaatgggccgggaggtaaaccatcttcgtcatgatatgaagggacgtctgaatgtgctgtaccgccttgtgataaaggagcggtacgacgaggcggccgattacattgaacgcatgggggcagatttgggcaattatccggaactgccacaggatacggggaatgaggggctaaatgcagccttgattaaggctgttcaggaatgccgggaaaagggaatccggttccggtacgtggtcatgggcagacaggacaggattgacagcatggacatgggaactcttttgtacaacctgatttccaatggaatcgaggcctgtatggaggcggggacaggacgggaattggaactggtggtgagggaggaggaaggaacaacagaaattttcatggaaaataccatttccgggtccgtgatgagggacaatcctaatctggaaagcagaaaaccggaggatcggtatcatggatttggcatggagactatccgtggtattgttgataaatatcagggatgctatagttaccgtgaagagacaggacggtttattcaggaaatcaatctgcgggaggtttctgaatgaaccgccctgctttttgtgtcgaaatagtacggtttatgctgtgccaattgttttttgatgctaaatccgtataataaaaccagagcgtgtttgaaaattgctttccgtcggctgtgcgtaattaacgggcgctttattcaccgctaattaaggtagtactaaggcagtatccttttatatctgtgtggattccgaagtgattctgccatctaaggataccctggaaaggtatggaaaaggaggaaatactatatgacggctcaaaacaaagaaccatacatggagtttatgaatgaagacttcatgaagaaaaattacccggaaggctctgtgttcaaggcttacaagaaatccctaaaaggagtcaatgcggggctgggcatgtttttcatgattgcatttctggcagggagtattgcaggtctggcctggtccataaacaggacattggagataatccgggatgcagaggaaaacatgctgggggttggaattgggatttgcgtcttttttcttttgctggtcctgttatttggagcggttatctttttcataacaaaggacatgagaaaaaccgtggatgactggatccgcttttttgccaaggcaggcggcttaagcgaacaggagatacgggaatttgataaacaggccatggagccggacaccttgatcctgaatcatcttgggaagctgaagtcatttacaaccgggcagaagaaagggatattaaccagggattatatctgcctttacggcagcaatgcgcccaatatactgaaactcagccatcttaaagaagcttacctgcaggataatacatactatgttaaagttgggaacaccagtaaacaggcgcattatctgaccatcaatctgaagaacatggatggaaaaaacgcatgggcagagacatcactggaagcagccagggcgctccaggaggaattggagagccgttgtcccgggattgacactgccggaggcgcggtgctgccgggataggatgagggggaaatggcatggaacatgaaacaacggacaggagaacagtggaaactgaattcaggaaaggcatgctgcgttccagggtacccatagggctgattataactgcctttggaataggcatgatagtattgataggcagctatctgatgaaatacttccgcggggcaattccgcttcgggaggtgtaccggacagaacaggcgggagaggaatatgtaagctttgatatagattatgtgctggacgttttcatggaaagctaccgcacccgctatggagtacggtccaagagcagcgtatattacctggtgctggacgaggaagctggacctgtccctgtccgcgtttccgcgaaaatggaggcggaaatggaccgaatcatggacgagacctgggattacttaagcggtgtccgtcctgttccgcctattgggatgcatgtggaaggaaccctgaaaaaactgaaggatgatggaaaaacatattttgacaggactgtcagcagtttcaatctgccatctgaaaatgagagctattacctttgggccggtatattggataatcagtcgccctccagtgccatgggaaccactggtcttggggctgtcatcctgtgtttggggctttttatcctggctccgattctgggtaaggaccatataaaagcagtacaggtatttctggacagccacaaaaacataaccagacaaatggtggatgaagatttccaaaaggtccggaagataagcggcacattctggctgggggaagacttctcatatggaataacgggtaagcctgtaatcctggtgaaccaggaacttaaaaaggtttgtttccgggtgcagagggttgggcgcgggaccagtgaagaattggtgtgcaccacggcggatggtaatgaatatgggttcaccatgaataagaaaaaggcagatgaggccatagccctctatcaggccagatatcctgcccttaagatgtcttccggtctcaaaggaagacttatgatgatgggggatggggatacagaaggcggaagccaggatgccggggaatgaaaggataggggtgtgtgtggaaagcaggatataggcatttcctatattggtatatactctgtcagggcgggtattattttaaatgccggttttcggcctttatatgtgtgcgtgtaaaaaggaaggggattttcttgtgaaagccaagaagattcccttccttttatgtttatctgattctgtttatcttaatctgcgattatattatattgcgtttatcttattatgcttacttaacaacacgcttattttgtattaacaacatgcttatcatgcactatgcttactttatattattttatatcatgctaatctcacaatatgcttatttgcattatgctaattttatatcatgcttactttatatcatgctattcttacatgatgctaatcttatatcatgctcatttttacatcattttatcccaatagcattcatgaagaatgaatcgtatgggtttgtaatgtccttaaatttactccgggattcatccgttattttgctgcttcctgtgaaaactgtgtagtaacaagatcttcatagggaacgcgctgtgacagctcgcctgcctcttctaagatattttccagaagttcaaagctttccttttcaaatacagtgtcatctttccaggtatcctggtccttgtagcggcctacgatagtggcgattttgtctaccggggtctccttgaactggggggcgatggtcttggcgatttcttcggctgagtgggagttcacgtagtccatgcctttttggatggcatttgtgaacttctggattaattccgggtttttctccatataactcttccttgcacaatatgcggtatagggcacgtagccggattccgttccaagggatgccacaacgcttccgctgccttcgctctccagggtggttgcaaacggttcaaattccacggtgtagtcagcgtcgtcgctggtaaatgcagcagcggtcagcccgaagttgatgctctggtcaattgtcaggtctgtcttggggtcaaggccgtgtttcttgaggatatactcaaataccatctggggcatgcctcccgcacgtccaccaaggactttcttacctttcaagttttcccatttgaaattatcttccggctggcggcccaccaggaagttgcctgcacgctgggtcagctgggcaaagttcacggcgtagtcctgggaaccttcttggtacacatagatgctggcctcggaacccatgaagccaatctgcgcatcgccggagataagggcggtcatgaccttgtctgcccctgcgccgttgaccagggtcaggtcgatgccttcgtcctcaaagtacccaagctcaatggctgcatactgtggggcgtagaagatggagtgggctacttcgttgaggaccaggggcgtgttgccggaggctgccccgcccggagtttttgaacagccggtaagggcagcggcggccaaggctcctgccagtaggatgcttataaattttttcatagatactccttgtatttgttggggtttagtatagtttattaagggggacgggcgggggtgagggaaaatgtgaaaatgtcaggataagaaaggggatatacaggtaaaaaactaaatcttgtggtataatgttgtaaatatatgtatttagtaacggagattcaggcgaagacatccctgacaggtacatttcgaaggatgataaggaggaaatgatgcagcttccatcttcagaaacaatcgatattgaatatttgggcagattgtttgacaagaaaagtgaatcatacaaattattctggtttttggctattgtagataaagtcagtagtggaaaatcctatttgatatacgatgagctgattaaccggatgattgcagattcatggtatatggttacggaattcaggctgaatctggggccatccgataccctggaagctcttgtaaaatatatttaccagataagcggacttaagtcaaatgaagaaccagatgtaatactctcttttttgaaccggcttaatgataagaaggtggctgaaatgaagcggaccattacacagaatgttccatacaggcttcaggccccctttacaaaacagataaccaatgatatgtggaagggttccagaaagaaactggcaaaaaagttaaatcaggaaaagcggttaatatattattttactgagcttgccggaatgaagactgctatcgaaatacagccggagtggtgtgactacatcagtaagaataaggagatattaagaggctgggtgaggtacaatctgattatgtatctgcaaagacggaatcccaatgtaccgggaattgcagagaaactggatataccgaaaagaagacggctgaatctggtcattcaatactggaagaagattattgaaataaaaccggtcagcgaaatatatttaaaccagtcactgacaagcaaaaatatatctattgaccattttgttccatggtcttatgtggctcataatgaattctggaacctgcatcccacgacaaagaatattaacagccaaaagggaaataacctgccggattgggacatatatttcccggcgttatgtaggaaagaatatttttcttataatatgatgtgggaatatgagatggttcacgaagcattcgaaaaatgcaggaacgtacatattaacagcgatgaggtttatatgaagctatataaaccgggattgaatgaggacgagttccgtaataatctggagaatatcatgctcccggtatataaatccgctcagaatgctggatttagaggatggaacttgaagagcatttagtagattatgcagcaatggatttattgattattcagttgggatgagaggagtaataataaacagatgaaagattcattagaatattataacctgcacgcaaaagagttttttgataacacaagggacgttgagtttacagagatgcagaaccggtttttaaaatatctggattccggagccaggatactggactttggatgcggatctggcagggatacaaagtattttctgggcaaaggctttaaggcagatgcagtggacggttcggaggagctggttaagatagcatcggagtataccggcgccagggtcagacagatgtacttccaggatttagatgaatatgaaatatacgatggtatctgggcctgctcctccattttacacctgacatacagtgatttgactgaagtgtttgtgaaaatggcccgtgcgctggttcctcatgggattctgtatacatcgtttaaatatggaacggatgaaggggaacggaacgggcgctattttacggatatgactgaggataagatgaaacggctattagatgctgccgatgtattttcagttgaggaaatgtgggtgacatctgatgtaagaccggggagagatgaagagaaatggctgaacatgattttgaggaagaagtaaggggcagaggtgatatgcagtttgatatcgggccatgtgaggtgatgacagggggaatggataaaatccgattccttttgtaccagttaaggctcagtatgatgaaggcagggcatatagatatcattgtgtcatttctcatggagtcaggtgtgaagatgattctggatgatctggaacaggctctggaacgtggcgcaaaaatcaggatattaacgggcaattaccttggcatcacgcagccaggggcattgtatctgataaaggataagttaggggaccgggttgaacttcgcttttataatgataagggccgttcattccaccccaaagcctatattttccgcaatggggattggggagaaatctatataggttcgtccaatatatccaagagtgcgcttacatcaggaattgagtggaattatcattttgacaatagacgtgatggttataatttcaggcagttttatcatacatttgaggatctgttttataaccattccatcataataaatgaccaggtcctgaagcaatattcaaaggagtggaaaaaaccggcagtccagcgggatttggaacggtatgacagtcttggcaatgaaacggaaggtgaaggaggatttgaaccaaggggagcgcagattgaagctttgtatgcattaaaatgcagccgcagggaaggtgcagagaagggattggtctatgcggcaaccggcataggaaagacgtatttggcagcttttgattcacttgactacgaaaaagtcctctttgtggcacacagggaggaaatattgaaacaggcggctgagagttttcggaatgtgcggcattcggatgattatggattttttaccggtcaggacaaatgcattggaaaggcggtaatctttgcatcggtatcaagcctgggaaagccggcttatctgaatgaggggtatttttccagggattatttcgactatattgtgattgacgaattccatcatgcggtgacggaccagtataaacggattatggaatatttcaggcctaagttcatgctggggctgacagccacaccagacaggatggatggaaggaatatatatgaattgtgcgattacaatgtgccatatcaaatcagtttaaaggatgcggttaataaaggcctgctggtaccatttcattattatggtatttttgatgagacagtggattattccgggatacacagggttaaaggaaaatacgctgaggaagagctgactaaggaactgctggtcaacagaaggtatgaattgatttacaagcactatatgaaataccgctcaaaaaaggcattagggttctgttgttcccgtaagcatgcggagcagatggcaaaagagttctgtcttaggcatattccggctgcagcagtgtacagcgattcagacggtgaatatgcggaggagagaggtgaagccataagaaaactccgggctggtgagataaaggttattttttcagtggatatgttcaatgaaggacttgatatcagtgagattgatatggtcatgttcctaagaccaacggaatcgccagtggtattcttgcagcagcttggccgcgggcttcgtaaaagcaggaataaagagtatctgaatgtactggatttcataggaaattatgaaaaggcaggctctgcccccttcttattaagtgaaaggccttattccagcgccgaagcggaacggatgcagcaacaggattttgagtatccggatgactgtgtggtggactttgatatgcgcctgattgatctgttccaagagatggctaagaaaagggctaagaaggaagagcgggtccggggagagtatttccgcattaaagagcagctggatggcagggtgcccacccggatggagctgttcacatatatggaggatgaaatcctgcaactgtgcgggagcttgaagaatagcccgtttaaacattatctgagatacctggacgggctgaatgaattgggggacagggaacgtattattttccaggggattgggaatgagttcctggagttactggaaaccacccagatgtcaaagtcttataagatgccagtattgatggctttttataatgatggggatattaagacggcgattgatgaagatgatatttaccgcagttatatggagttttatcatacagcgaataactggaaggatttggaaagagataaagggaccagtgattttaaatcatgggataagaaacgctgcgtcagcgaggcattaaagaatccggtaaggtttttgatgcagtccggcaatggattttttgtgcaggaaaaaggggcggtgctggcgttgaatccgcagcttcatgaggcggtacggctggatgggtttgcggagcagatgaaggatgtgattgagtatcggtcgatggattattatcggaagcggtatgaaggggcatcaaactaaggcaattcttttaaaatcggcatatgcggaagatgataatattgaactgtcaacatatgtaagtaataaaaaaccgatttttgcggaatgattgaaattgaaggtgggatttgtgtggaaaagagtaccggcacctttagcaatgtaaatccttccatgggaaattgtctggagccgtggtgacgatattccatgctggttggagcaggaagttttatgattttcaggatagaatataaggccagacagacaatgatgcattttttcacgtacttatctcaataacaaaggagctttccatgcacatcctaattgccgaagatcaccccgacctccagaaaatcctaaccctctatctgcagaaagagggctatcaggtatccgttgtatccaacggacaggaggccataaactaccttctggagcacagcagtcccgggaagccgaaatccttaaaaaagccggggtatcaaaaaacggcccctgaaaaaccggcctgtcagaacccggaaagccaattaccatttgccccgccaactattgcttcatcaagcaccgcgccaccacccattgcgccgccaactactaatccacccaccatccccgacctcctaatcctggactggatgatgccggtccaggatggcatccagacctgccgtgaaatccgcgccctgaaccttccaatcaaaatcctgatgctgaccgcaaagggggaaacagagcatgaaatcctggggttaaccagcggggcagatgactatgtgcgcaagccattcgacatcaaggtgcttctcctgcgcataaagaagctttgccgtctggaaggtatcctgtgctgcggggacatttccctgaaccaggagacctttgaggtaaggaaaggcggcaatccggtagtcctgaccaggacggaatatgaactgctccgttatttcctgaacaaccagcggattatcctgaccagggagcagctgttaaaccatgtatggggaatggactttgagggcgacagccggaccgtggatacccatatccgcaggctacgcaggaaaatcggagaggagtatataaagacccgcatcggaatcggctatgtcataagtgacaggaaagattaaatagagcatccggtgatttcactggatacattgtgggagcatcgggagtatgaaatttttgctgtattttatgtagatgaggtggaatggatacaggaaaacggccaaatgtatcaggttctgcatagaaaaggtgtaagtaaagccaaggcagcttatgctttcaaagagtcggaagagtatgatactggaatcacaccggaatcagattgccctattaaaatagtgcagaaaagatagtctttaatggtatggaaatctaatagtgataaatggtaaatattctaattcagaagttaagttatgggaaatgccgctctctcacgttgatatggagatgcggcatttcctgttctatttttaagtgcctgccaaatcagttaataaggcaatatcttctttcaactgttccaaaaacgcctgggcagcttttgaaaatggttggtattttttccagacaatatagaccccggcgtttagtcctggcttaaagggacgaaagcacaatttactgtcagaagtaccagtaaacaaatcaaaatcaatacagatagaataccccattccgtctgcaaccataatcgtagcattatagggcaaatctgttgtggctataatgttcagtttctctggcatttcgccaatccatctggttaagaatccatattccataaactgtcttggcataataagtggaagaccccgtaaatcttccgggcagattgcatctttttgtgcaagaggatcgtctttcctcataatgaccccacaagattccgcagcaggctgatagagaaaatcgtattgattcacatccaccggctcaatcagaaggccaaaatcaagaagccctgcttccagccgttccaatatttccatgctgttgccgctatagatatgaaaacagatgtcgggatgtttttctgtcagatgtctggcggctgtagagaaataatggaatgagtcgaattctccggaaccaatatatacctctccgctgacggcttcctctctttttgctaattcagattccgtcttcttgactaatgttaaaatctcatctgcgcgttttcgcagtaaaataccgtcttccgtaagggtaatattccgattgctgcggataaacagctgcttgccgacttcaagctccagctctttcatctgcctggataagtttggctgtgtcaaatgcagagtattggctgctcccagaatacttccttcccgtgctacagccaaaaagtagcttaatgtgcgtaattccataattttgtatgctccttccgcgaaatatcctgaagctatcgtgttatagtgattatagtatcagaaaaagatatacttatcaagtatatctggatataaaatacaagtatttgatatatcaacgattttctattacaatgatttcagaggtgatggatatgtcttatttaccgcttaatagaagggacctggcgcagacactaaccgattcctgttatccgcctgaaaagatacagcaatttctggaggcatatgataacggacaaatgaaggaattaatttcagttttgtctgcacaccggagagctcttctaaataagattcatgagcgacaagggaacttggattgcctggattatctgatttatcagttaaagcagcagtctgaaacagcaaacaaagagaaatcataggagaggttcatatttatattgatgggagagggtcatatggtaaagaagaaaaatctgaattatgatgaagtggcaaagaatattatcgctaatataggcggtaaagagaatatcaacagcgtccgccattgcattacccgtgttcgtttccggcttaaggatgaaggcaaggccgacgatgggattgtgaagaatctggaaggggtgctttccgttgttcatggaggcggagaatatatgacggtcattggcgatgcggtggaagatgtgtatgatgcggtctgtgtgcagctgggaatgcaggatggagctggaagcgaaacggaagcagaggaagaaaagaaagtgaatccggccatgcgtgtactgaatatgatcgtcggcgctgttcttccctgcctgaatatgatctgtgcaggcggtatcataaaaggattgcagacagtacttcagatgactggcatgattcagtccggaagcggactggatttaatcattagcgcaatgggagatgcaatatttttcttccttccggttttcctgggaatgaatctggcaaagacgttaaagggggatggatttttgggtgccctcattggcgcaatcctctgctatcccacgattaacggtgtgaacctggaattgtttggacatacaattaacgccacatataccagttcctttctgccggttatcgcagttacggccgttgcgattccgctggcaagatggttaaacaaatacatacccaaagtggttgccaatttcgtgacaccggtaattaccctggcggttgttatcccgtttggatttaccctgattggaccggccgtcaatctggcgggcagtctggtgaacacggggattaccgccttgctggatacagttccgctgcttgccggtattatattttccgcattgtatcaggttatggttttatttggtatccacactgcgctgacatcattttctttcatgagccttctggaaggaaatccggacgcagtcatggcaatgtcctgcctggtctgctttgcacagactggtgttgtattggggatttactgcaaaaccagggataggaagctgaaatccattgcgctcccggcgtttatttccggtctgttcgggattacagaaccagccatttatggagtgactcttccacgcattaaaatgtttgtattgtcctgtgccggagcgggtattaccggggccatcattatgctgacaggtacgaaaatgtatagtttcggtcttggggtatttgctgtccttggaatggtgaatccggaagctccgaactttatccctccgcttctggccgttgtagttccgtttgtggtatcatttatgcttgcttacgttttacataaagatgaggcagtccatgcttctgactctgcacagataacgccaggcagcgaaacagcagtccatgagaaacttatcatcgagtctcctgtaccgggaaaggttgtttcaatcagccaggtacctgatgaaacattctccagcggtatacttggtaagggatttgcggttgaaccttcagaaggaaaagtgtatgcgccgtttgacggtacctgcgtaaccatatttgaaaccttacatgccatgggcctggaatcaggcaatggggtcagcctgctgatccatgtgggacttgaaacggttggactgaacgggaaaccatttaaggcccatgtcggtaatggagataaaattaaaaagggacagctgctgctggagtttgatatagatgggattaaggctgccggctgcccggttattacaccggtattagttgccaatgaaagcgaagttggcaaagttgagatagaaaatgataaaattgtgattggaggctaagaatatgaaatttcctggaaattttttatggggcggcgcagttgctgcccatcagtgtgaaggtggctggaatgaagatggaaagggaatcggtgttcctgatattatcaccaatgggagtcatacggtcccgcggagagttgattccagcctggattcggaactgttttatcctacccatgaagccatagatttttatcaccattacgaagaggacatcgctctatttgctgaaatgggatttaaggtatttcgcctgtccatcaactggacccggatttttcctaccggtgaagaagaaaaagcgaatgagaaagggctggcttattatgataaggtgtttgactgctgcaggaagcatcatattgagcctttggtgacaatttcccattatgaactcccgtatgcgttggtagagaaatacaacggctgggctgaccgccgtctgattgatttatatatgaattattgtaaggtcatcttcgagcgttataaggataaggtgaagtattggctgactttcaatgagattaactgcggtacgctgttcactggaacaacgattgcaatcagcaccgttcagggatatacaggtccttccctggaagctcccgtcacaatgcagacacgttatcaggcgctgcaccatcagtttgtggcgtcggcccgtgctgtgaaccatgcccatgaaaactatcctcaatttaagatgggaaacatgattgcatttttaccggactatccttatacctgtaatccggatgacgtgttggcagtccaaagccatatgaggatggtgaactggttctgctctgatgttcaggtgcgaggcagttatcccagctattccagacgtttcttcgcagaaaataatgtggagattaagatggagccgggggatttggaagaactgaaaaaggggacggttgatttttacacattcagctattacatgactttctgtgtttccactgatccttctgtagagtgcgccgccggaaatctgttgggaggggcgaaaaatccctatttgaaagcttctgactggggatggcagattgaccccaaaggtttgcgctggacgctgaacgagatttatgaccgttaccaggttccgctaatggtggtcgaaaacggtttgggagcacatgatgtgaaggcggaggatggaaagatacatgatgagtaccgcattgactatctgcgtcagcacatcgggcagatgggcgaagcgattgccgatggcgttgacttaatcgggtataccccatggggctgcattgaccttgtctccctgtccactggcgagatggcgaaacgatatggttttatctatgtcaataaatttgatgacggaatcggtgacttgagcagggaacgcaaagatagtttttactggtatcagaaagtgattgccaccaatgggagcgacttgagttaatattgataaaggctttgtattctgatataatgacacgaaaagggggcgggaatatggaacttcgggtgttgaattattttctggcggtagccagagaggagaattttacaagggcggcgcagatgctccatgttactcagcccaccttatcccgtcagattgcacagctggaggaagaactgggggtagagctttttaccagaagtaatcataatatcattttaactgaatctggcatgatactgaagcaccgggcgcaggaaatgctgtccatggcagagaaaacacgtcaggagctgctgcagggagacgaggaacttaccggaaaaatttgtattggaagcggagagtttcaggccaccagattactggctcagattatttcttctttttcggagaagcatcccctggtccagtatgagatttacagtggaaatgcggaaaacgtccatgaccatattgaaagagggcttttggacataggattgatggcagaacccattgacatccgcaaatatgattttgtttccatgccggtaaaggaacgctggggagcctgggtatgtgcggattctgacctggcacaaaaggaatggattcagccggaggatctgatgggcagacagttaatcattgccaaaggtgaatttctgaaaagcagtattggaaaatggcttggtgatttaaacacccaggtgaaaatcattgcgactggtaatctgctatacaatgaagcgatgcttgcggagaattgcctgggtatcgtgcttggaattaagctgaactgtacgtttgaacatctgcgctttattcctctgtatccttcccttgaaagcagtacagccctggcctggaaaaaagagcaggtcttttcccctgccgccggcagttttataaagtttttaaagcaatacgaaaaagtaatatctgatgataaaatataggcattagacattacaacataaaaggattaagatgagggtgttcctgaatggagcacccttattttcatgagtaaaaagcgaggtggaactatgacaatcaatgaagcaagtgaacggtatcatattccggttgaagttttaaaggaatatgaaagctgggggctgtgtgatgaagtaaagaaagtgatgggggtatggcagtacgatgaccaggatatacaaaggcttagtatgattatgacgctccatgacgttgggtttgacaacagcgaggttgagtcttatatgcgccttcttctggaaggggattcaactgaaaaagaacggctggatatgttaaacaaaaaacggggagcgactcttgacgaactccattttaaacagaaacagttagaccgcgtggactatttgcggtacaaaattcaaaaagcgcataagtaaggttcaaaaagaaggaggactctacaatgaaaaaaatactatcgttcatctgggcctgttccatggtgtttgctgtgactgcctgcggcagtcagggcagtgtgcctgctcctggcataacggcaccagcttcttcacaggaaaccggcaaagaggtacagcaaacggaacctctgcagagcggcagcggggagaacgcctccgttacggaggaaaacggtagggaagctggtcctgatattctggtcgcatatttttccgcgacgggaactacgaagaccctggcaggatatatctctgaagttaccgggggagatttatatgaaatcgtaccggaaatcccgtattcatcagaagacttgaattatagtgacaacaacagccggagcaccagagaacagaatgatgaaggcgcccgtcctgtaatctccggcagtgtggaggataaggaccagtacggaacaatctttctgggctatcccatctggtggggagaagcgccgcgtatcatcgataccttcatggaatcttacgatttcagcggaaagacgattgttccattctgcacttccggaggcagcgggattggcgccagcgcacgaaatctgcatgaccttgcagccccggatgtaacctggctggatggggaacggcttagcagtgatatctcacatgaggaaatggtgagctggattgatggtctttcactggatgtgatggcccggtgaagacggcagagttaaagaggatggtggatgtatgcctgcttgtcatgcttcctgttttgatggcagaaatattgaccggtcaggaatttcatgaatggcttgggacggcgatggccgttgtgctgctcctccatcatctgttaaacataaattggttaaaaaatatcgggaaagggaactacacaccgcttcgcagccttggcacggttatgaatttgctcctttttgcagatatgtctgttttaataatcagcggcatcatgatgagtggatttgtattcgagtggctgcctgtttcaggaggcatgattctgtcccgcagacttcacctgtttgcttcccattgggggctgatcctgatgtccctgcataccgggatgcattgggggatggtggtaagactgggaacaaagtttcggaagaaatcagaatcagaagacggactgacctggcttgccaggggcctggcagccgcaatttccatattcggtatctatgcttttatacagcaggacatgccagactatctgttcttaaaaacggcctttgtcttttgggatgaaacgaagccggctgctatattttttttagaaacactttccattatgggattgtttataacagccggttactatggacagaaacaaatgaaaggattaaaagggatcggcatgaaacataagacggcaaaatatctcacttttataattccaatcctggtctgtataggggttattttctggctgatgagaggaaaccgtatgtccccagccggttcatgggaagccatgcctcctgtggaagcagaagaaaatctctcacaatcagtcaatcagaaacaggaggaaaaggaaagtcagacagaaataaacgatggttttgtcttggtttccggtggaacgtttttgatgggaagtccggagagtgaagcgtggagaggggatgatgaacagcagcatacggttacggtcagcgatttctatatgagtacctatgaagtggcacaggaggactatgaagcgctgactggaaataatcccagcagttttgaaggttctgaactgccggtagatagcatttcatgggtggatgccattacttactgtaacctgatgagtgaacaggcgggattgaatccggcatatcagatagatggaaatgagattttctggaaccgtagtgctgacggttaccgtctcccaacagaagcagagtgggagtatgcctgccgcgcggggacaacaacaccctttcatacagaggactccatcagttcagaggaatgcaactattgggggaactacccctatatgattaaggataactattttaaccagagcaacttagaaacacgccccggaacgtccaggtatgaaaccgttccggtggacagctttgaaccaaatagctatgggctctataatatgcatggcaatgttggggaatgggtctgggatttatatggagcgtatggcagcagccagcagacaaatcctgcaggagcagatacaggaaacctccatatcagcagaggaggaggctggaatgactttgcaaagaatgtgcgttccgcttaccgtgcaaccgcccagggaggacgcggcgcttataatgtgggcgttcgtcttgtgagaggagcggtgccggagggaggtgttcttgtaagcggccggtcaatgcaaaaagagacgaatgctggaagggttttaatcgcttattttagctggggaggaaataccagagggattgcaaaagaaattgcggtacagacaggagcggatctctttgaaattacctgtgtggaatcctattccagggattacaatacagtgctggaagaagcgcagagggatcaaaatgctcaggcacggccaaagctggcggatcaggtggaaaacatggagcagtatgataccattctgcttggatatcccaactggtgggcatccattccaatgccggtcgcttcgttcctggaagaatatgactttaaagggaagacaatcatcccattttgcagccatggcggcggcagatttgggcagagcctgactgtgattgcaaagctgacatcggacgcaatgattggcgagggactggcggttagctattcaggcggctcgtccctgtcatcggatgtgagtacatggcttgaagataataaggtgaaatgaacaatggaaggaggtaaagggaacatgaagattgtagttttacagggaagtcccaataaaagcggttctaccagtattttgacagagcgctttacaaagggcgcaacggaggccggacacgttgttgagaggattgatctaagggataagaaggtaaaggcctgcacaggctgtgtcgcttgtgggtacaacggcccttgcgttcagaaggatgataacgggcagattaaggaggcaatcctgagtgctgatatgattgttttggccacgcctttatattacttcggaatgtcggcgcagttaaaaacggtggtagaccgattctgtgcttacaacagcagtattaacaggaagaacatgaaatctgctttgcttacggttgcgtggaatgcggatgactggacatttgatgcattggaggcccactactgcacacttgtaaagtatctcaatttccaggacgccggaatggtattgggcaaaggctgtggaagtccttccatgacaaacagtaccggctacccaaagatggcatacgagctggggagaaattgctgaaacgaagcttggacagggaagaaaagctgttaaatgaggacggtaagattgactatacgagatttaaaccgatattgtctgagatgccggcctattcctatttgagaggagaaagaaaataatgaaaagagcatggctgctattgcttacgcttctcataagcatgacaatgtctgtgactgcgtttgcaggtgtttggaaaactggagagggagtaaatcaaaaccgatggtggtacgacaatgaagatggtacttatgtacagaatggctggcagtggctggatggaaatcaggacggaattgcggaatgttattattttgacggtaatggatggatgctttctaataccacgactccggatggataccgtgttaatgagaatggtgcctggatttcggcaagcggtgtggaaaccagggctgcgcaaaatacgcctgccagttcagaaactactgcaaaaggagaaaatgtgttaattgtctatttcacaaggacaggaacaacagagcaggcggcacaacagatccaacagttgacgggtgggaggcttgtggaattagaggcagaagccccatatagcggttcttacgaaacaacccttgaccgtgcagaacgggaacttcattctaatgcaagaccggcgctgattacccggatagagcagatggaaacttatgatacgatatttgtgggatatcccatctggcatggagatgcgcctatggtgatcgatacatttctggagtcttatgattttacaggtaagacaattgtaccgttttgcaccagtggtggaagcgggattggtacaagtatgcagacaatacgtggcttgtgtcctgattccacagtacttcagggaaggcggattggaaataccagtgagattcagacatggcttaatcagactggattgaatgcaattcgttattgggaaaagaaaatggaataagggaggatttttaatgagtaagattttagcagcctatttctctgccagcggcgttactgccaaagcggcggctaatctcgccaaagctgtaatggcggatttgtacgaaatcaaacctgccgttccctacacttcggcagacttaaactggaacgataagaaatcccgcagttcggtggaaatgagtgataaatcccaccgtccggagttggctgatcactcggcccctatttcggagcatgatacgattcttttgggttttcctatctggtggtatactgcgccaaccatcattcagacctttctggagagttacgattttgctggcaagacgatcatccttttcgccacatcaggcggaagtggactggggggaacagcatcggagctgtcgcacagttgccctggcgctgtcattaaaaacggaaagctgttgaatggccgcgagtctgagacatcgttgcgtcagtggatggagggtatgtaaacggaattttggcgaatgccgatgattcaataaaaactaaaaaacagttggaggaagaaatgaaaaaattattgaggagaaccttagcagttacaggctgtgtagccatgatggcatccatggcggcatgcggtgcgaagcctgggacacagacggaatcagcacagacggaatcagcacagacagaatcagcacagacggaagcggcgacacaggcagaaacaacggcacaaacagaaacatctgcacaggcagaaacggaaggagatgcgatgacaatgaattatgggaacatgaaggatgttagcataaaaatggagccaatcgaactcacggatgaatgggataaggtttttccgctcagtgatgaagtaaaccatagaaaggtaacatttgttaatcatttcggtattactctggctgcggatctttacgaaccgaaagaatatacgggaaagcttccggccattgcggtctgtggtccttttggcgcagtgaaggagcagagttccgggctttatgcacaggaactagcaaaaagaggatttctggctatctcatttgacccttcttttacaggagagagtgctggatatccaagggatttcaattctccggatattaatgttgaagattaccaggcggctgttgattttctttccatacaggaaaatgttgattctgaaaaaattggaattatcggtatctgcggctggggtggcatggcagtgcagactgcagcacttgatacaagaataaaagcaacggcagcaatgacgatgtatgatatgagcagaaatacggcgctgggatattttgattctgtggatgaagatggaagatacgaggcccgtgcagcttacaatcatcaaagaacagaggactataaaaacggtttttacacaatgggaggaggacttcccgaagaggctccggaagaagcgcctcaatatgtgaaagattatgttgcatattacaagaccgggcgcggttatcatccccgttccgtcaatgcaaataatggctgggcggcaactgccagcggttctctgatgaatatgcggctgtttgaatatgctccggaaatccgcagtgctgttctgcttgtacacggggaagaagcacattctcttatgtatagccaggaagcatataagctgttacagggagataataaggagctgatgattatccccggcgcttcccatacagatttatacgatcggatggacatcatcccatttgataaattggaaacattctttcatgacgcatttgcacagtagttacggattatactggaagcggttaattcaaaagcagtaatgccagattccaggtagaacggtgagcatatcaataaaaatcctcctatgctaaaatgagaatggtgtcgcaagccaaactcaagcacaggaggaggtccaaatggacaatggaagcttatcacatactcgttggaaatgccttgtaagtaatgaaaggtgtgaagcggtggaacaatgcgggtaagtggaagtcatagcaggagcagtgtgtataaatcatgtacatttaagcgtagcaatcgcgcagaagataagtatttcgaattttatgggaaatctgaaaggaaaaagtacactcatgttatacgacagacaccccgaattgcaaagtaagtggaaaaagtattttgggcacgagggaattaaatggaaatagttggtgatattaccgatgaagcagtaccgaagtatacaaaagcgcaggcagaagagtcacgaaaagaagattcgagaggtacggctttatagcggaccagtaacggtgcttgcgacacgccctttggggagagcagtaagatagcccttttggggctaatggcaaaccaccagttgaacgggtggttgctgacttagataacggaacttacagacaaccacacgaaccagtatatggccacttatccggccagacacaaacagaaaaccagacctatgaataaattatggaaaaagttcatctatggaacggcgttgattatggccttcaccctaatcctttcccttgcagtgaactcaaagattgtagggaaatactacctgcgcagtcaaaaacattatatccaggacattggaagtcagctgattacccttttggaaagcggtacaacgccggaaactgctgtcaggatcctggaagaacaggaaaaggtcctgattgtatattcaggcaacacatcggacagtgaagccctcagcaatgaactgcgcgaacagttccggaaaaagggattaggcttccagaagttctggctttgggaacaggattaccaggatgcggtggaacacggcatgaagctgcgcctttatcagcaggaaaaactgaagtatgggattctggctgagtatatgtttacggataaaggcatgttcgccattgccgcggtggttcccaataccgaggaaaccgttggcatcttgaatcagttcctgattatccttctgtccatttcatccgtggttgcagtagtcctcatgtatatcctggtgaggcacattaccaacccattaaaggagatggaggagttttcacgcaggattaccgggcaggattatggcagcaggctggtaatccgtaccaatgatgaactggagacagtggccggcagtatgaaccgcatgagccaaagtattaaggaatatcaggacatgctgcttgggaagaaccggcagatggaggcgctgctggacaatgtggcccatgacctgaagacgcccatctcgctgattggcacctatgcgtcagggatacaggatgggctggatgacgggacatttttagacaccattatccgccagaatgcgaaaatggcccggctcacagaacagttattggggttgtcacggattgggcagaaggaatatccggaagagaccattgcccttgaccgcctgttacaggaacaggttgaggaacagaggatatctgctgttcagagaaagctggagctttccgcatcaatagaaccgaatcagcatatcaggggaaatgcagaacttgtttcaactattttctctaacctactgtccaatgcaattaaatatgcggcagagtccgggcctggtattgaaatatgtctgtatggaaatgacgctggctgtcattttaccatatccaaccagatgcaggcagagaatctggatttagacagaatatgggaaccattctatgtcggggagtcctcccgcaatcaaaatctgtccggtaccggattgggactgcctattgttaaaaagattgcagaacaatgcggttatgggataaattgtgccgcagaagacgggagaataaaatttacggttattttttaaaacctgattttgtcaaatgaatgtaacatccccttattatactgggtctgaagtataaaaatgataaggagattgacatgacaaaaccaggttttttattccggggtgcatgcatgctttttgcggtatgcctgaccgggtgcgggattcataatcccattgcagacagtaagggggcggatgcggcgaaggtgcccgccgtccttcgggaacaggaagaagcttctgattttggggaagccattggcatggcatttgagtatgaggtggattcggaaacatttgcgattgaactgtttacagcggatggttcagtgcgggcagctttaccgcttcaggagagggtggtggaagattaccggaaaagggacgaggaagtctcatggcggtatcaggaagatgggattgctgtctccgttacccctgaagacgattacctcagtgttacgattacttcggagacagacagtgacaacgcctttacatggccggaaatatctgcggacagctattatttcccatttggtgagggaaagcgggttccggcagatgattcggtctggaaggattatctggcggggcagataggccagcccaatctggcaggacaatccaatccttctgccaaggaattttccgtccttgaacagttttccatgcctttttggatatcatccgctggagattacgcggtcctgttcatcatggaagacccattccacacgaaaataggtttcagacaaaatccggatttgaccttttcactgaataatgggtttccggctattgatacggacaggacaaagcggttccgcatctatcttacggacaatgaccctgtctctgcggcgaagctctaccgtaagtatgtgaaggaaacggaccggtttgtcacattggaacaaaaggcagaatctaatccaatgataaggaagctttacggcgcaccattcatatatctttggggcgagcggctcatttcccccgaggacgtgaactggccggccttccgtaccgcaatagggtcgccgttcatgaattaccttatatcattttcatcccaggtggagaatggaaatgaaatcaaagcggccctggatgaaatccaatcccaggattatgttgcggactaccagaaacatctggtatgcaattatctcagcggagtattgaaactgccggaattctattggcagctgtcttcactgccttatgaatcgtcctacacaccatccaccgccccgtccactgtaccctccgatgcaccgtccgccctccggcatgcatttaccacatcctcccctgaattggcatcgcttctggccccgggatatgaaaacctgaacgaatccaatcaaatccaggttaacaaatatatcctgtccgcaaaccttccggatgtattcggcaaaccttccggttggatggaccaggatacggtgggactgatacggcagatgaaggattccggcatcagccaggcgtggattgggcttaacagctgggaacaggcatatgcgaaaccggaacttgtggaggaggcggtaaaccagggctacctgattggcagctatgattcctatcactccatacatgaacctggcagtgagcagtggataacggccgcatttgaggatacatccctgtatgaccgggcagcggtggaggataggaacggagagaagataaagggatttaagggtgtggggcgcaagctgaatccggtcctgtcacttcctgctgtcgtggaacggatgctggatatcatgggaaatggacttccgtttaattcctggtttattgactgtgatgctaccggggagatttatgatgattatacaccggaccatattaccacgcagcagcaggacctggaggcacggctggaacggatggcatatatccgtgatacctatggtatggtcatcggctctgagggcggccatgattttgcggcttctaccattgcatttgcacatgggattgagatgcagagcttttcgtggatggatgacgatatgaaggaaaacagggacagtgaatattttatagggaaatactataatccggacggtggggtggcggagcatttctccagacggattcccgtaaaaagcagatatcagacactgttcacagaccccaggtttgatgtgcctctatttaaactggtctataatgactccgtgattaccagctatcattgggactggtcaaccttcaaaatcaaagaccagaccggaacacgcatgctgcgggaagtcctttataatgttccgcccctttatcatctggacaccgtccagtgggagaaatataaggacgatatagtaagacataatgcggtatggtccgaattcagccggaatgctgtcacacgggaaatgaccggttttcaatatctgaaggaagacggttccgtgcagatgacggagtatggggataagatacaggcagcggctaattttaatgatggaccttttatatacggaaatcaggagattccgggaaagtcggttttaatcaggatggatgggaaggaaacggtttatacaccaaaaacagcgccggataattcgtgaagataatgttgggtaacccataaagccagcgttggatgattcatgaagacaggatggaattcatcctattcccatgaatttaaggatgatataagattatccttttctttccagtgtttttgcggtaaagtagataaaaaagcaccccattgcatatggtaagattttggattgcatttcattttaagatatgggttaaggatggattactttaccaagaccggaacggacggtacagaaagataatccatatccgcctgaatgtatttccggttctgacacaggtatgtgtgcaggggacgattgacggttgctttccgttccctgcatgtcccgttttatacatttcaatataatgcaaagtgaggtgtgcatggggcgggaaggaatcgggaaacacatctgggcaaagggagacagggataggtaaaggaggtggctttatggctggatatataatgacacatagtgatgttgactctcttacatattgcgtaaagacaggaacatacagcaccaatctcagtgcaccaaagggaaattggatgacgcatcacgaagggacatttgctgattatcttagcatgaaacccggtgacagcatttatttttttattaagaggaaaatatacggtattgggaaactgattgaaattaattcagagtgcaggtttttaaattatgttggtgcggaccggccggttgattattcaaagaaaaactatggggaactggaaccgctattggacgaaggaactgccaataaccgctgtttgtgtgtgtttgagccagcgcctctgttctttttaaacggagtggatatggatgatgctttaaacagcaatccggacaggttccgcatgctgcgggcaatgtggaaggtttcatttattaaagtggatgatgatgagaatcaggcattgatggatattattttaaaaagaaatgaagaaaacctgcttcgtaatgaaaatgcatatccatattctgatacattacataatcagatcagggaaaaatacagaacagtacaggctgacagcggataacatacttctttcatgtgcaaaaggaaataagattaatcatgagatggcgattgaagccgcactgtgtgaattgctgtcagaagataacagcacaccaatgggaaagtgggattatatttcccatcaggtggttgcctcaccgtttaaggcgattgattatatggataaaatggatatattcgggtacaggtatattccaggatacaggacgaaatccaggtatcttgtagtggagataaaaaaggacgaggcaacggatgatgtcattggacagataatgaaatatgtggattggattcagggagaatatgcgtacggtgactattccatgattgaggcatatgtagtggcgtcaggtttttcagattccgtcagacggaaaaaagaccgggaatgtgtaagatactatacaaaaggctgtcggcctgccatatcatgtatctggtcatccgtgaaattgattcaatatgaattcattgacaataaactcaggttgagggaggtatgaagtgcggataacatcagatattgcccgctaccatgccataatttcacataagaacaatgaaaacgggaatccctatactgcaaaggataaccatcagggaccggttacaagatgattttcactgacaggcatcaggaactctcctatgccaagaaagcggtagtctatgggggtaaaagattgaatactgaagccgctggaacggatctgagctggagccaatcacacggaagacggtatttcaacagcttttataggaagaatacaggggagaatcccaggaactatctgaccgatataaggatgaagggagccgtaaagctgcttaataacacggatgataaggcaaatgaggcggctaaggctgtggggtataagaatgtacgccggattaatgaggattttaaagggaagtaatagcagaacccaagcaaatacaggaaacccagcgggagaagcagggcacaaaggcaggggacggatgggaaatgcagcacgctggaggaaccaaagtgctaaaactcagggtgccggaggacaacggatttccgaaccatgctccaatgccatacaatttacctccgggtgttccaacgccattcaatctggtgccgtccgtttcctcctcacgtccatctccattctatcagccatcatgcttccagtaatcacgctgtccgcctgctccgcccggatgacactatccggtgaaggcggtgcggtccataaaccgtataccggactggctgtcagctcagatgggatttccaatccggtcaaactccgcctggtatactccgccagcgaccttaaatggaaaagagtggttgaggacacggcagaggcgttcatgagggaaaatgaggatatagaggtggagctttacagtatgccggaaaataagtgccaatcccaccttgagtccctgaaaatactggcggcccaaaaggaattctttgatattgtggaaatacaggaaacctccaccctggttgccgcagggcttctggcgccggttccggagggagtttctgccctggtggaaaatccgggaatatatgaaggggtgtgttatggtgtaccccggtatgccacgacgctgggaatcatttacaataaagatatatttgttggactggggctgtctgaacctgacacatatgaggatttcctccaaatctgccaacaggtaaaggatgcaggccgcaaccccctggccctgggggcagccgatgtgcggcatatggaatactgggcagattacctgttcaggaattatatggttacagagggcggagaagtgcagtggactgccaaacgcacccggcagatgcttgccgattaccggaatcttggggcacaggattatataaacccggaataccgcaatgcttccgacattaggacagcccaggaactgtcatcggggaaggccgccatggtgtacgcaggtccctggatgctgtcacggattgaggacctgaatccgcagatacatctgggatttttcttcctgcccggcaaagacgggattacctatgcggtacaggaccgcaatgtggaatgggggatatccacggccacggcccgggataaggagaagatggaggcggcggaacgtttcctgaaattttattattcagaaggaatctatgaaaatatactggccgccatggatggggacccggtgaccgtgcgccctgtcaaccgattacatatgcaaaaccaggcaatcatggagtcggcctattccaccaatccggtacgcaccgggataatgatggaaaatgccgaggtccccgatggatttgccgcctgctttgcccaacggctggtggataccctttggggtgaggagagtacgtcctatctggcggatgacctgacccgtatatgggagagggaggcgccatgatacagacaaggagaaatgttttttaccgcctgaccctggccttcatctttggcgggctggtgccgctgctgattgctggtaccatgctgttttacaggtttaagggagatatggaacaggtcatactggatgacatgggccggacggtcggctgcgcggtccgtggtgcgcgggaaatggtggacgggagcagcagtctcaccaagcacatgtatgacatttacacagaggatggcagactcctttaccagctgcttaaggataagtccatggcagaccaggagaaacgcatccagatggccttgttccttggagaaatgctggaggaggacagcaggatccgcaccgcctcatttgtggatagggaaggcaggatatattatgccaccaggaacatgcagaaggcgctggatgaaactgctttccggcaatggatatcgcaggaagggtacagcagtgaggctttttcagcgcttcccacccatgcggacagttatttcccagattccgggaaccgggtcttaaccttccgcagaagttaccaggacctgacatcctttaagaccattggaatcagtttgggaaacctctatctggacgtggacgttggaaagctgtcttcggcgctttgggatatgggggtgggggaaaatggaacattttccatcattgacaaaaatggaatctgcatttacagcatggatggttctgagataggaaagccgttggaacgtatggttccttacctgtcttccatgacggaaacaaggggatacctgactgatgcaaggcagcatgtggtttatgaacggatggacggctgtggctggattgtggcggcccaggtggggagggacgctgtcatgagcagccttaacggcaccgtacagagtatcgtggcgtttttaagcggtactttcctggtgctgctttgcctgtattcctactctgcgaaacacatatggaggacagtggggctgctggaacatgaggaaaatgaaaacgccggaatagtggaaagcctgtcacggcaggtggaatacctgagcagcggcggcagcatggttccgctgaaaaaggaaatcgggaacatacgggattatttctatatcatggggattcagcatgaaaacaggattcagctggaagtcagtgcggatgaggatgtaatggacgcatccatcatcaggatgagcctgcagcctgttgtggaaaatgcggtcaggcacggtttattacccaagaagggagacggcaccgtgagtattgaggcccgccgcaaggacagcatcctggaggtcactgtcatggatgatggcgtggggatgacagaggaaacacttacggcccttaatgccggcccggaccaggatgggacggatgtacagaccggtgataaggggctggatactggaatcaggaatgtccatgacaggatacgcaggaccttcggaccaggatatgggctgaaaatcatgagtaatgaggggaaggggacggttgtggtattctgtctgccgttcataccgggcaaggcggagccggaggaagaggggaacgcgcagcaggggtcagatgggacttcttctgacaggatatgtgaataagggataatggcattgttaaggttgtatcaaagcaatctttctgctaaaataaacccatggaatcatttccggaatctatcaaacaagcaggggagaaaaagcaatggactataagataatcgtattggatttagacggtacgctgaccaaccgggacaaaatcatcacgcccaggaccagggacgccttaatggaggcccaggaagcgggcaatatcgtggttctggcttccggacgcccaacgcccggcgtggagccgctggcaaaggaactggagatggaccgtttcggaagctatatattatcctataacggggggatgataaccaattgcaggacaggagagactgtattttcatccctccttccgctggagtccaatcagaaaatcatcgggctggcggaagagcaccgtgtggatatccttacctatgagggggaggaggtcatcaccaacaacaaggaatgtccttatgcaaccgctgaatccaacatcaaccatcttccgctgcgccaggtggatgacatgaagtcctatgtggattttcaggtacccaagttcatcatgctggatgacggggattacctggtgaccgtggagccgaaggtgaaggctgcgatgggccgtgatttcagcgtataccgttccgaggaatatttccttgaaatcatgccaaagggcatagataaggcacagtccctggcccgcctcctggacatccttggcctgaagaaggagcagatgattgcctgcggggacggatacaatgacctgaccatgattaagtacgcaggtcttggggtggccatggaaaatgcagttctgcctgtgaggaatgcggcggattatgtgacggcttccaacaatcatgacggcgtcggcctggtggtggagaaattcatgctgggacgcgggcaggatgtgctgtgagtggacggatacatgccggtaatccggcagacatacaatgcacacggtgaaactttacattgaaaaagtgttatcatgtatggactttcaaactttaatatgttaaaatgagtgggtatgaggcttatggcctgtccggatggtatccaggcatgccaaaggcctgtgtcccttgatgcagggacattgattccacaactacatgcggtcgggggagagtgtgaaccgcataaattataaggagagagaaccaggacatgaacaaaaagattaaaacggacgcagtggatcatttatttgatgccatactgacactaaagaatccagaggagtgttataagttcttcgaggacgtgtgtacgattaatgaacttttgtcactttcacagcgctatgaggttgccaagatgctgagggaaggcaagacctatctggagattgcggagaaaacaggggcatccacggcaaccatcagccgtgtgaaccgctctctgaactacggaagcgacggatatgatatggtgttttcaaggcttcaggtagaaagtgttgttccggaaaaggaagacggcagataagtaagcggaagatgagtaaacggaagcagggaaatggaccagcctgtcagcggtgatgggctgcaatgtaaaaaagcagataatataatatataaaacgtatatcccggcatatcaaccaatatgccgggatatacgtttttaaattccggatagctgttcccaaacacgccatggattacaccatgaatcacttcttccgcggaggcgttgtctccccgcgcagctggtccgcaatcatctcaatcatctgcgtcttcagatagacatcaaaggacagttcacatataaatgcaaagagctgcaggtattccttatcttcctcatccaccggaacgtcctggaaggttttacgggagcgggtgaatttgccggtcacgtctttcatcaggttacccatctcacccttttccagggtaaatacctctgtatagatatcttccaaggacaggggggaatccttgccggtaaaatgtctggatgtgatggggcggaacagttcctcaatatcattaaaggataacaggctcttaaagtaatagatgaatatcagcatgagcatgtggtccttggaatacttcttcttcacgggcgggggaagcaggttattcttggcatagttgttaatcatggtcttggtcagcaccttatcctcaggatggcgccgcatatcctttaaatggccttccatgaaggtggtaacctggtccatatataaatcaatatcaggtatttcttccggcttaacatgggacagacttcccaaataggccagcagatcccgaacacgttcttcatttgtcttcatctgtcagtcacctctgtctttgaaatcacattgctatatctattatatagtattgaatactagatgacaaggggcaaatgtaagaacatggcaaaatactttgacagtagcagaaaccgccatattatgatatattgtatgtcagaggaatttgcaatcaaatcgaaaggaataagtatgcgggacgatatttgcagggaagcaaaacaattgattcagagtgtgatggaaggctatatatcgggcaacccggagatactggccggattacttacatattgttcaccggacgtgcttgtcattggaacgggacggcatgagttctacctgggcctggaggcattgacggaaggaatgaggaaggaccaggaggaggcggacggaatcagctttgtcatcagggaggcctggtatgaggcaaagctgattacggaaaacagctgtgttgtctatggggaattcaaggcccaggaaaaggatacggacgggaaggaagtcatcattgacatggatacaagaatcacggccgggcttcaccgggatgacaacggacggcttgtcattgacagcctgcaccagtccgtgccttatatctaccagcaggagggcgagtactatcccaagaccattgcggaccaggcagctgcagccctggaacggaccgccatccttgagaagaccatacagctggattccctgaccggcctgtacaacaggaagtatacggaaatgcacatcaccaggcttttgaccaaggaccatgaaagcggcctgatgttcgtcattgatatggatgattttaagaaggtcaatgatacccatggccatcttaaaggggatgagctactgaaggaagtggcggcagtgcttatggactttgtcccgccctccgccattgcaggcaggataggaggcgatgagttcatgattttcctgccaggctccacagaaagggagcagggggaaagggaagcccgcaccctgatccagtccatcagccgaatcctcctgaggatgggactggaccagagctgttccatcggcatcacacagataagccgggacagcgggacatttgacagcgcctaccggaaagcggatgaagccctgtaccgtgccaagaccagcggcaagaacatgttctgctggtgggaagggcacggggaagaaggggagaccggggactgcgcagataagggatgcgggaacggtgaagaaggaaaatgcagggacggcggagaaggagtcgtgcagaaggaaccgtagggttttaaagttgcacgatggggccaggaatggtatacttatacatctgacacattgaatgaagaaataaaggcggtacataaaatatgagtatttacgatacattaaaccccatgcagaaagaggctgtatttcacaccgaaggtcctcttttaatcctggccggagcaggatccggcaagaccagggtgctgacgcaccgggtggcctacctgattgatgagaaggacgtgaacccctggaatatactggccattacatttaccaacaaggcggcaggggagatgagggagcgtgtggaccagctggtaggctttggggctgagagcatatgggtgagcaccttccattccacctgcgtaaggatcctgcgcaggcacattgaatgcctgggatacaccaccagcttctccatctacgacagtgatgaccagaagacattgatgaagcaggtatttaagagtctggacgtggatacaaagcagtttaaggagcgctccgtgctgggcgtgatatcctcggccaaggataagctgatcatgccagaggagttccttctgaacgcagggcaggatttccgccagaaaaaggtgggggagatatacagggagtaccagaagcagttaaagaagaacaatgccctggattttgacgatctgattgtcaagaccgtggaactgttccagaataatgccgaggtgctgaactattatcaggagcggtttaaatacatcatggtggatgagtaccaggacaccaaccaggcccagttcaagctggtgaacctgcttgcggataagtacaggaatctctgtgtggtaggtgacgatgaccagtccatttaccggttccgcggggccgatatagagaatatcctgagttttgagtcagcatttccgggtgcaaaggtcattaagctggaggagaattaccgctccacccagaacatcctcaatgcggcaaacggcgttatccgccacaaccgcggaaggaaggataagaccctgtggacagccaatggggaagggaatctgatccggttcaagcagtttgacatggccagggatgaggcggattatgtggccagacagatacgggacagtgaatttgcctatcaggaccaggccgtgctctacaggaccaatgcccagtcccgtctcatagaggaacggtgcattttctataacgtgccttaccgtctggtgggaggcgtgaacttctaccagcggagggaaatcaaagacatcctggcctaccttaagacaattgccaacggtgtggatgacctggctgtgctgaggatcatcaatgttccaaagcgcggcatcggcgcgaccactatgggcaaggtgactgcgtttgcatccgagcacggcatgagtctctatggggcgctgaaggaagcgcgccaggttccggggctgggtaaggccgcggagaaaatcctgaagttcgtggggcagatggagagcttcagggccagggctgaatcagaggatttttccatccggaacctgattgaagggattatggatgagaccggttaccagcaggaactggaggcagagggcgagattgaggcccagacacgtcttgagaacatcgaggaactggtgaacaaggcggtaagctatgaggaggacagcgaacaccccaccctggacgaattcctggaacaggtggcgctggtggctgatatcgacagcatggatgagtccgaggaccgtgtgacccttatgacgctccacagcgccaaaggcctggagtttcccaaggtatacctggtggggatggaggacggcctgttccccagcatgatgtccattaattcagatgacaggacggacctggaggaggagcggcgtctgtgctacgttggcattaccagggcgaagaaggaactggtgctgacctcggccagacagcgcatggtcaacggagagacaagatactgcaagcccagccggttcctggaggaagtgcctgcagaattattggatgaagaacgcctggagccggtgtttggaagctatggcggccgcggcaacggtgcaggacagggaaatgcctcaggctttggaagcagtgcgggcgatgcaggacttccatggaaccagtctgtggcatcgggacgtacaagcacattcggcaagggctataatgcctatgcgtcgaagacggcgtcgccatttgacgggtttgacagcgggactgccggaccgggcagcggggcaggatctggcggcggcgttgggacaggcagtggggcaggatctggcggcggcagtgggacaggcagtggggctgtgtttggcggccgtgccggaggagctggatatggcggaggtgccggatatggcggaggtgctggctacggcggaggcacgggctatggcgggaatgccggctatgccggaggcgctggctatggcggaagtgcgggtcatggcgggcccggtgggaaaccggcttttggcaaggcatttacggttgaaaagcctgcttccctgaactacagtgagggagacagggtaaagcatgttaagttcggggagggaaccgtcaagtccataaaggacggcgggaaggactatgaagtaacggttgaatttgacacggctggtcagaagaagatgttcgcatcttttgcaaagttaaaaaaaatataggatggctggttaaaaattcaagaaattgggatagtaaaaaagggacttccatggtataataattaaaaatatgtatctgagcttattgcttgcatataagaaaggacgtggaccggatgaacaggtttgacagagacagattcgatgcaatgggaaaagaggcattaagccgtgtagaagaactgatgaattccagcagaatcaatgaactgcttcacaaaagagaggaagatgagaagaagaaaaactgtatcctttgggtactggccatcatcggcgccgtagcagccgtggcaggtattgcatatgcagtgtaccgcttctttacaccggattatctggaagattttgaagacgactttgacgatgattttgacgatgacttctttgaagatgaggagccggaggagaaaaagactgagaagtctgaatagagattacggatttaggaaggaccgtcccctgtgggatggtccttttttcggggaatggaggaagtgtttggaggtttggaaacggggagtgaatattcaaaattactgcatccctgaaatgatttctctgaccgtgacatccggatgtttataccggttccgtttttgggtggctgatttccactggattgctttttgggggcagcaattgatacacgcaacgcagtgttcacattgatgctggaattccaatgctccgttttttaagattatattgtgattggggcatatgttttggcagataccgcattgtatgcatgtatcgtcaacatgaaacccctggtcatgattgaccttaatatctgtatatattttgtagaataatttgtctgcggccgaataacggaagggggaattgctgattcctgcagctatttcactggcggccagttcagccagcctggcggcctcttttaatctttttcctgcaagatggattcttggattatattcctccacgaaatttgcaactgctttgatttccctgccataatccagcttcaaatccttttttgccaacaatctgtctacctggcccagtaccccgccatgcagttcaccataggtggggaccgcaaaaatatatggggaatcccggctcacgcgcagtttatctatgaattcccccacggtccggggaacaccccagaaataggttgggaagaccaggcctattttatctgctgtgcagatggttcctttgtatttcaccatgggcagcatctctgcccccagcttctgtgatatgattgcggctgtcttcaggctgtttccggttgccgaaaagtaataaatgactgttttcatgctggctctcctcctgctgcgcagggcgtttttgatgatttaatcccatgcgatagcctgattatagcatagtacgatgaaaataaaagtacttagattttttgctgtacattgctttattgtagtactggctgtataattagcctgaaatgaggtgatttcaatgaaaaaggaaacgggtgttcctgaacgctgtgcaactatctctgcagtacagaaaatccttgggggaaaatggaagctggagattctgtattacataggttttcaggatattcagagatttggggagctgcgccgccatattggagggatttccgagtcatcactgacaacacagctgcgcgaacttgaggctgatggatttatccacagacatgattataaagaaatcccgcctaaagtagagtattccctgactgaacttgggaaaagctttatgccagtaatggaatatgtgaaggcatggggggaggagaatctggggaaatgataggcatgaggggaggagaatacggggaaatgacaggcatgagggaggctttgtgtgaagtttgagttagtttatgtgcgggggaatgggggactttctttttttggtaatggtcgtgataggatgcgggggagcgataggctggatatgatgataggatgcggggagcgataggctggatatgatgataggatgtggcgatagcttggataggatgatatggtgtggttattgactggatatgatgatttgaatgtggccattgaccggatatgataacttgatgtgtatttaaggacatgatataatgagacgatgaaaaaatggaagatacatgtgatattatggcaggggtatcataatagcaggagtatcataatagcaggggtatcataatagcaggagtatcatagtgtcaggagtatcatgacagaaacggagataatagaatgaaaaaaggcgagatttacgaaggcattgtcgaaaaaatagattttccaaataaaggaatacttatgatagatggggaacgcgtggtggtaaaaaatgcagttccgggacagaaaatccaatgtgtggttacaaagaggaggaaaggtaaaaccgaggcaagggcgctggaggttttggagcgttcgcctttggaactgccggagaatgcatgtccccactttggcctgtgcggcggctgcatttaccagagcctgccttatgaagcacagctgaaaatcaaggaggaacaggtaaaatcccttttagacggcgtggtggaaccggatagctatgagtttatgggaatcaaggccagccccctggaaaagggatatcgcaacaaaatggagttctcctttggcgatgaggtaaaggatggaccgctggcgctgggaatgcacaggcggggaagcttttatgatattgttacaacaccggactgccagattgtacatccggatttttgcagggttctggtggctacgaaggaatatttcgaggaacttgggactgcattttataaaaagctacagcacaaggggtatctgcgtcatctgctggtacgccgggcagtgaagacaggagaaatcctggtggatctggttaccagtacccagagggagtatctgggcggcagggatgaggcggctgtgttatccgggtggaaggaacgcctgctggccctgcctgttgacggccggtttgcaggaatcctccacacggaaaatgattccctggccgatgtggtacagagtgatgcaacccatgttctttatggacaggactttttttacgaggaactgctggggcttcggttcaggatatccccattttcctttttccagaccaactccatgggggcagaggtgctgtatgatacggcccgcggctttgtaggggagacaaaggataaggtggtgtttgacctttacagcggcacagggaccattgcccagatactggcgcccgtggctaaaaaggttgtgggtgtggaaatcgtggaggaagcggtagaagccgcaaaggtgaacgccagactcaatggactggataactgcgaattcgtggcaggggatgttctgaaggtgattgatgacctggaggataagccggacctgattgtcgtggatccgccaagggatggaatccatccaaaggcattggggaagataattgaatttggggtggacaggattgtgtatatttcatgtaagccaaccagcctggtgagggatttggtggtgctgcaggagagaggatatagggtggagaaggtttgtgcggtggatatgtttccggggacggggaatgtcgaagtggtgataatgatgtcacttgtggagtgaggtggaaatttagatagataaacacaatatgttatggtttttcagatgaagaagcatgtttaaccactatacgttatggcttttgagtggaataacagtgaaaatcagccgatttccagctgtgaatttaagggtaaaaacgcataagagtagatgagattccctggtttgggtagtgaaccaggggattttctattactcgtaacgctgtataggaagggaaggcggcaaggcgggctttcacggagcagaaaaagtccaaaagcaggacaaggaccagtggaaagcaccaggccaaatacgccctggcagatatcatggtatgcggggagtgcggtcattactttaggagggtcacctggacaaaccgtcagggtcggaaagtaccggtatggaggtgcagtagccgtttggaaaacgagacacaattctgccataattccccgaccatatcggaacgggacatacagggaagcatcatgaaggccatacggactttattgccggaggaaaaagggcaggatgaaatattaaaggaaaggatgctggacaatgttgctatcttttatgaagcctatacctatgagcagctggaacggattctggtgggactatctgctaggttgaagtattatgaagggttagacgcatcagacctggcacctgataaaatacgtgttcaaaagaagatggttatcattcaggaggaaatcagaagcattgcaggggcgtatgaaaaaaataaaactgtaccataagatttgcagggataacctgcttcaagaagtagagcaggcggttgcaagccattattgagtataatgaagcgatggtacgcaggctgataaacaagatagaaataagatcaaaggatagatacgatatgaccctaaaatccggtcaggtgatggaaatctcaatgtaaggatgtacataggagaatgaaccatagggaatgatgaccggtatcctggcacaggatatcggagctgataggagaacgggaatctggtattgaattaatctgtttggctgaaaaccttcagatgtatgctgaggtttttattgttggcagatgatttaaatgaaccatcggcaataacaactgttttttatataaataaatggtacaatatactcaagaaaaaatataattattataagagggggatatattatggagaatacagatattgaaattttaattgaaaaaattagcagtttaattgagaatctagatacatatgttgccagtttatctaatcaatccatatcctggatagagattggcacattaggcgtagctcttttggcagttgcagctacttttgtttctatttacgggactattaaatgtgataaaaagaaccgtgaagcaaacgaaaatatagctaggcaattacaagcctcagaagataaacgtgcagaagcagcgattgatgcaaacttaactgccagtgcccgtattgaatggatagaaagagttcgtcaagcaacagcagaattaataacagcatgctacaggtatattgaatcgaaagaaatcgagcaaataaataaaaatttagaaactgtacaggaaaaaaagtccttatttgttttgtattttggaccagacaatgatggttcaaatgaagtaatggcctgtgatttgtatgataaaaaaacgaataaaggtaaaaatgataaaatagttttatttgtggatgatttatataatgaaatggtgagctaccattttaatcgtataagtgctgataggtgtagaaaggaacttgcgaaatgtagtgaatgtgagtatatgaataatgagggggagcgggagtcgtacttatgccaaaaggatgaatatacatattataataaagaagattgtgaaaggatgaagagagagcaaagtgaaggtttggaatgctataataaaaatatgctatttgcttcaacacacattcaaaacctaagtgaaattatgcggatatatggtaaaattgaatggaatagggcaaaacagggaaagtaaggacaaattttctgttatagtaagaaattgaaaagaatattccgaaatttctgaaagcgattaatggcgactatatgataccagacagtgaaaacatggagtttcggggagatgaggaagtcatcgcggaatacagtttttgtttccatgacacaagcgaatcagaggcatagagttttgtaaaatatattattcatgagacagagtataaattcaataaggaaagttataagttggaagcataggaatccatgtaaaaagattgggtatgagctgactcgatggaatgaaacagcatatttggggatagggtaatgtgagaaaaggaaattattgaaaagcggtcaacctcttttgttatcaggaaagcagggggatggctgaagctgctatcctcgctagaagaacaggatgaggcatttgctgtcttagatgcaatggaatcgggtggtggtatcgtccgttggcaatttgcctgattatatctgtggaactgttttaaccagtcaaactttagctgaattatcgtttctgtcgaggcgtatggagtggacgagtgagattgaaacgtctttatttaacggagcgcttgcaattatgtgacttaatacgaaacaaacaaatgttccctcgaggtttgcgcaatagagattaaaccgatataatagggagagggaggctgtgagatgattcggttatttgaatttatggatttagataagattatgaacatatggttgcaggaaaatttggaagtccattcttttatagaatgtaagtatgcccagaagcatacagatacttgatttcacggaacagtgtgtgaaatatgatgtgccattctggtttaatcagactggagcaagattcaaaaaggaggataaagtgtatttgatagattggaagaatcaaatgagtcaagcgcagaaagccagggtgaattatagatactgaaagctacattctcgtcttgatattgataaaatagtttaagatataaatgcattaagaacgtgtgtatttattgaataattaatgctaagatatatatgggcaacttaaggcaaagacggatatgggttcgtatatttttaaggatatagtgtattgcaatgactactaacgatttttgcaaaatggtttttccaaatcaagaagaaataattaagaatcgctgtattttgtgatagtagtattaagaagctatttttgaattaaagatggaaaacattaatattgattatgatatatgggaaaatcagactttcgaataatacataaagctggagataaagatggatagaagagggattaaatggtcaaaagaggaaactatattagcatttgatttatattgtaagatgtcatttggaaaaatatcttcaactaacaaggagataattgagttggctactcttttagaacgttcaccaggttcagtagctttaaagatgcataatttggcacactttgatccagaattgcaaaaaagaaatgttacagcaatggctcatggaagcaagctggataaggaagtatggggggagtttagtaatgattgggaagaattatcgtttcaggccagaaagatattggcaagaaaaaaagaagaagcggttgagggtattttagcagatgctgaaattcagacgttaccagaggggaaagcaaaagaccagatagttcggaaccggattgggcaacatttttttagaatggctgtattgaactcttatgataataggtgttgtattactggcctggctattcctgatttgcttatagccagccacataaaaccatggaaagattcagatagtaaaacagaaagaacaaatcctatgaatggattatccttaaatgctttacatgataaagcatttgataaaggattaatcagtatcacgaccgactatagagttattatttcatcagctttgaaacattcactaaagggtaataatatggaagattggttattggaatttgcgggaaaaaaattaaaatgccaagtaaatttgctcctgataagcgttttttagagtaccataatgatgttatattccaaaagtaagtaggatgaaatagtgaaattacaaaataagatggattatctttagtgggaggagaaaaatttacatataaggtaacaaatatattataagcatggaaagttgatttttttctgactaaatatcatgaaatgaggaatagctaaatataaagtttaaaaattttttgaaatctaaaaattaaaatgaattattaggttgattaaagcgtttatggtgattgacaaaaggatatagttggaagggaaagatatgaaaatttattcatcacttactgttttttcaacattggatgttgaaaagacggctgaattttataataagaagctaggctttagacgagttgactatttgcagtcacaggaaccacatatttgtctttatcgttcttctgtagaggtagtcctcatacaggcaagtaatgggcaacgggcaattccgaatcgagaactatacggttatggtgaggatgcttattttataacagatgcacagcaggaactgcaggatgagtttgaagcagctggtgtggaaattattgagcgcgttcatataacagattgccataaccttgaattttcgatatgtgatagcgatgggagaaaaattatattcggaatgaagcagtggctgactgttgaagataaaatatggcaagagctttattctcgtgcaaaaaatttaactgatgataaaaaactatctgattttattcgggtgggtggtgtagctgccgcaattatgacggataaagggaacatctataccggtgtttgcattgatgccgtatcttctcttgggatgtgcgccgaaagaaatgcaatggtcaatatgataacaaacggcgaaagcaaaatcagtaagattgtcgtagttaaggaaaatggaaccgtagatgtgccgtgtaaagcctgtcatgggtatatgatgcagcttgacagggacagtaggaatatagagatattgatagatgctgaaatgtggaaaacagtaatgcttggtgatttgacatcatactggtgcggagataagcagtaatgaaagacaagtatatcattaaattacggctttcggcaagacacagccacattttgcagaagtctttttgtatactcaagccatgtcgcaacttgttgtttaatgtcaaaagcataaattataagaaggttgatgattaactaacaagggagcggaatgctgatacgtcatcaaaaacaatgcaacaagaaatgttgaaacctgttgtttgctgtcgaaaaaatataaattttcaatggtttaagaaaatgctgtatataagtatcaatagaatatagggtatgattgatcaggatgatggtttgaaaaaaattgaggtcaatatacagaacgaaaatgtgtggtcactatcctgaagcaaacagccgaattattctagcgagataagttgataagctcaacagatataaaaaagcacctgtgaaaaaggaaaattagaacgtgactcaaagacacttatattgatttctaaagtaactataataaaacgtgggaggaagattgtttatgccaaaaaagaagaatgatattacaatacacagctctgccgcggagtatttgacttatgtggcttcagtaggggatagcaacgatagttttgaaatgcgttatgaggatgagaatatctggctgacacaaaaaatgcttgcgactttatatgatgtggatgtgcggacaatcaatgaacatattaaaaaaatttatacagatgacgaactggcgcaggagtcaactatccggaaattccggatagttcaaacagaaggttctcgtcaagtgaatcgcgaagtgattcattataatcttcagatgattattgcagtcggctttaaagttaacaacgaccgcgctgtaagatttcgcaaatgggcaggtcagatcgttaaggattacacaattcaaggttggacgatggacaaagagcgcctgaaaaaagggcatatgttcaccgatgagtattttgaacgtcagttggattatattcgtgagatacgcctgtccgagcgcaagttttatcagaaggttactgatttatatgccacagcgtttgattatgataaagacgctaagactacacggcagttttttaaaatggtgcagaataagatgcattgggctgtacatcggcatacagcagcagaattgattgtagagcgtgctaatgcagaaaaagaacatatgggcctgacaacatgggaatcagcgccagatgggaaaattgtcaaagcagatgttaccgttgctaagaattatctgagcgaaaaggaaatgtcctatttacagagaatcgtttcactgtatctcgactatgcggagttacaggcagaacgaagaataccaatgagtatggaggactgggcaaagcgccttgatggattcctggagtttaacgggaacgagttgttgatggggccgggaaaagtcagtgcagaacaggcaaagcttcatgcagggactgagtttgaaaaatatcgtattgttcaggatcgtttatttatttcagactatgataagtatttgttagaattagaacatcaagcggatcaaaatgacgcttaaagataattatgtcgtttccgttaagggagaagtatgtcctcctgccatcattattatccactcaacaaatgtggaggtggtgacattgatgtcacttgtggagtgataagaaaatgggaataaataccacaatatattgtggttttgagacgaaaaacggacctgaaatgacaaaaaaacagctgtgtttctgaaccatgaaaatagcggttttaatgatatcatctgatttgagactgataggaacgcggtatttccctaaaacctgcatgaagaatggatgagctgtatgataagatatagaattaaaaaaagataaaaattgttggttatcgggatgataaccagcaattttcaaaaagcagtatgatattgggaaatggttgatgaggttgaagtaggcagatatgctgccattatggtttaactggtatggtctgaagattaaattataatggggaatactgagatttcctgggggaatgatgacggaattcgctgtcaatcaatgattactaaccggttaatctgtgatatactgtaagttatacaggtacaaggaaggggtgaacctatggattatgagagaattgttcagaaaaggaatcggtatcaggcagtaagggattccattccggaacttaccctgcaaagctatgagaaggcatttgagatagaatatacccataactccacagcgattgaaggtaatacactgacccttatagaaaccaaggttttgctggaagatgggatttccattgggggcaaacacctccgggaactttatgaggcagtgaatcatcagaaggcataccgttatgtgaaggagtgcattgcaaaagaactgccgttgaatgaaagaatcatcaaagatatccacgctatattgatggagaatatatttgtgggaggtatctaccgagatgttgatgtatatatatcgggtgcacaacatacgcctccatcccccaatgaaatgtactcccaggtcaaggatttttatgcggaccttacatggaagggcagggagctgaaccagattgaacttgcagcctggacacatgcggagtttgtgcgcatacatccgttcccggatggaaacggcaggacatcccggttgcttatgaactatcagttgatggcaaatggatttcctgctatttcgatagcaaaggaaaacaggctggaatatttcaatgcattggaagcatatgctgtagaagggaacttagccccatttgcagagatggttgccaatctgacagtgcatcaactggactgttatctggagatggcaggagcggggcaggagatgggacagttcccatgcatataggaaaaattaaacaatgatggtgttgcgctggatgcagggatgtgtctggcgctttttaaataccaaaattctggttgttatatggttggaagattcgttgataaagataggtggaattaagtggtcagcttaagggaaatcccccggtttgagtagcaaaacggaggattcctgctttgaagatgattcgggagagatcctaaaggtaagtgaacgcagatggcagatagagacctgtttccggatcatgaagacggattttgccgcaagacctgtgtatgtacaaagggaggaccgcatcaaagcccacttcctcatctgttttttagcattactcgtttaccggtgtctggagaacaggcttaataaacgttacacctgcggggaaatcctttctgccctaagaggctttgcctttgcggatgtacagggacagggttttatccctatatacgaatccacggaattgacagatggactgcacaaaataagcggttttgaaaccgactatgaattcctcaccaaaagcaggatgagagaaatccagaaaatgagcaaaagaagacaagctagttaaaattccttaacgcttcctaaaaacaggaaaaagactatatatcaaaacggaacaacaccgctgtaaaaccctgatagaatgggcattatagcggtgttttgttaaaatgactgtcaaagacgggaattatatcatttgtgtggtgcattttcaatcctactcatataataattgagttaccagaaatagtggctgcatttaggaacccagcaaaaaaatgggtatctttttcaattgggttctatgcatgttgaagtatccacagatgtacctgccagatgaatttatgtggacaacgcgccatatttatctttgtttcacgtacgtttctccggagctatacaccgtcattttaggtttaacaattgataagatacagtaattttcctaaaatctttgcttatgctatattggagacaggatgtgagggcgcaaaatgaagaaaaaccggcctcagaaatcgatatcacttgaaggattactgaaagggcttagggagcagaatgaatatcaggcaaggattatatctatgcaggaagaaaaccatcagtcttcaaaataagcagaacgaggaactggccaaaagcagttattgttatcagggatcccttcgaaagaaaccagatgaaatcagtccagaggtggaaaatctaatccaatgtgatttcagggcatccaggccaaacatcaagtggattacggataccacagggttttcgattccagatgaggaattagattaacatctacactggtacaatgaaacctgtattaagctatctttaggtggaacgagtccgctaaactgtaggagcagtctgggggaacagcttaggtccaacattgtgtccacagcccctgaggaaagaaaagtagaatttaaaaaagaacaaatgttcttttcggccttgcaaaatagatactggtccgatataatagagggacagggaggcggaggaatgattcgattatttgaatttcgggatttagacaagattatgaacatatggttacagggaaatctggaggcccattcttttatagatgcagggtattgggagaaaaatttcgattccgtaaaatcagtgttgcccaatgcggaggtatatgtgtacgaggaggatggagaagtcctgggattcatcggtatggatgcggattacattgaagggatttttgtggcggcaggacacaaggggcagggaattggccatcagctgattggagcagtgaaacagaagaagcggctgtccctgcatgtgtttgaaaagaataccggagcgatgtccttttatctggcagaggggttcaaggtatgggagaagatgacagaaaaagaaactggcgagacggaatgcctgatggtctatgaagacggacaataaggggttgatgtgagcgcgggtactcctggaatgtttggttgaggaaaccggaggtagtggtatggcgacctggaatccatggcatggatgtaaaaaaatcagcccaggctgtgcgaattgctatgtttatcggagggatgctgaatttggtaaggatagcagtattgtaacccgtacctccagctttgatatgccggttaaatgtaaccgcaggaatgaatataagctgcagctgaagggtgaggatgtgtacacatgcatgacttctgatttttttctggatgaagcagatgcatggcgcccggaggcatgggatatcatccgccggcgggggaatctgcactttgttattattaccaaacgtatccatcggtttgcagtgggattgccggaagactggggaagcggatatgagaatgtgaccatctgctgtacctgtgagaatcaggaccgggccgattaccgcctccctgtttttctggatttgccaatcaaacaccggacaatcattcatgagccaatgctggaacagattgatatccggaagtatttggctacagggaagatagaaggggtaacctgcggcggggaatccggaccggaggcaagaatctgtgactttgcctggatacttgattccatggagcagtgtgtggaatatgatgtgcctttctggtttaagcagaccggggcaaggttcaagaaggggaataaattgtatttgatagaccggaaggatcagatgagccaggcgcagaaggccgggttaaattataaatacggatgaacaaaatagctgcccaatggactgtcaaggttgtggcgcagtttttcctgtgtcacagtgtacaccacaaatgaaaaagcatttatgaggaaagcattttcgtggcgattatcccgcgcttcctacttgtggtgctttgcaaaatatgctatactacgcaagaaatgatatccgtatagggcgggggcagtttatatctttaatgatattaaagtcagccacctttggtggttagaactggaaatgtaagcctatacacacgttttgtgtgcgtgggcttatttttttcgccatgccgcctgatagataggaagggatatagacaatggcaacgactttttttactgcagttctatcatttgtaagcaccaacatcgacgatatttttgtactgatgatactttatgcacaggtattggattccaagagggtcatacagataattgccggccagtatttcggaatcgggtgtctttgcgctttgggaacattgggggcattgggtacacagatcatccttccacagtatgttgggcttttggggttcctgccgctgctccttggtatccgctcttggagggactgccgatgcagacaggataaatcagaaacagaaacgcagaacaagactcaaatcaatttttttagcgttaccctgctgacaatagcgaatggggcagataatatcggggtatatgtccctttattcagcggatatacccacgcagattttatgattacgctatctgtttttgcagtgatgattgccttatggtgttatcttgggttccggcttgcaagttacccatatattaagaaaaaaatcacccattaccaacatatccttgtcccgcttgtattgattgccttggggataagcattcttgcaaagaattatctcttctgaggatatctcaacaacaaaagagggattccccctgccaggagcaatgcctacgtttgttgttaaccaatcgctatacggcctgcaatttccatgtgggtttgttgcctcaggcggcagcttgctatgacaagctcgggtttcatgttcattctgttttggtggatggtttgatgagacagataggatgtgaagcagtgactcttttatggcggatgttaaagaactttgatattgtagtcaatgttaaaatctcaggtatgtagtccatgcgggctgcgctggagtggattcagatatttggatacacgtagaatttatcgtgccgatgattggtaaggattaatcataacgaaagatgagccgttgtgcagcgtaaagccatcgaagtaaagatttagtgaaatacagagtaagctctgatgttaagaataaagttattagtataaacgatgagggtttccagctgatattaattgagttaagactatatttcttatctaaggtttcttatctaaggatgtaaatggcatcttcaaatcttcatatctatgatataattttagaacaggaggagagatgaaagcggtttattgatgttacttgtggagatgagacggaaaatcattctggaatgggaaaatccgtttataatgttattcagaagagttgcgttgactgtttgctaaactgtatcaggcagccatttacagccagtctggagatgcaggcccatgaggccgggattgggttgaggatggattataaaaaatgacagtctttcttagacaaggaatctgtttccataaggatggaagtatgcttgtggcgttccattttagaaatgtccttttccaaattgacatatacattaaatttgttggactgtgtgaactaaatgtaaaacaggagattagataatcaaaagtaatatagaaaatgcagagcaagttgatattgttacggtgtagcagattaaaagaagtttgtgatattatatattgcagtcttttagataaggtaattaaggtgtcaaacgaatggtaggacggtacgatgaaagaaaatttatgagagggacatttcacatgaaaaagtacaaaatttataagcatatcggcagcctatcgcaagtaaacaatgggtggataaaggaactcaatcttatttcgtgggatgatagggagcctgtttatgacatacggacctggaatgatggacatacagaatatggaaaaggagtaacaattacggcagggcaaatggcaatactaaaaaccctgcttaatgaaatggaggtattctaaccccccatttatagggacgctggacagagaggagacctggaaggtgataagaagcaaaatgctatattctgatttaaaaagtatgttgagggaatataattgggatgacggatttgaagtaccaaaagaaatcctttctgattccaactgtgatttggcgttggctttagaaattttttatctggctgacggttacagctatttggaaaaatcagacaagacggctgttttacagaactggaatccctttatcacgactctgtatcgtgatatacttaatcacaaatttcgaaaaacagataccccctttaccaacccgctgaatgaggtacagaaatatagattcaggaaaaaacaggttccagagattttcctgacagacttataagtttatgtttatcagactgacaaatcggtattgtaaggggaaacgaagaatgaaaaagacaggtttgataccattcattgctgtaacattatgcctggctgcctgcggagcagataaaaataacgaagaactgaaaggcagtacaacggcttttgagattgcggtggatgcaaaggaaaacggggaagggccaataaaagaaaatgataatctattagatgatattatttatataggagagtatttggacagcgatgttgaaaatcctaatcttgagattgccaaaggcagcgatggtaaatatatagtacaaatagggatttaccgcctgacttcactggaggacggtgtcggagaactgactgctgatggcctgctttttacagcgacagatgctgcagggaatccaatcagcggcattattacgggcgatggacagacagcaactgttacttttacagattcaacatgggagtaccttccgaatgactcatctttccggtacacaaaagcatctgatacccctgatttgtggaatgactagattaaatggtttattagcttgttttttaccgcagttttgttatttccatcactactaaaattaaggaccatagacaagggatataagacgaaattacaaaattcccatttatcgggagttgcacaaaggagattattggtatatgaagtttagggaaaaagacattcagctaacgaccgatggaatggggattgtgttttattcacctaaaacgaatacggatattcctgaaggttatgacttccttaacgaagaatattcaaacccggaagatgtggcaaagcacatcaaaaagggggatgtgtggtgggcttttgtacagggagtagcggaaattacatactcaagttcagagcgggatatccagatgaaaacctgctggcagaatttcctgttgcgattcgcttgggcattgatattcaagacgaaaagttatgtgtgattgatttgttctggttgtcagagtggggggcggagtgtcctctggaacaaattatttcaatcgattcgggatattatcatattactttatgcacaagaaaacctgattcaggaagttggcgccgcggacagacgatatttgtgtatttaaacaaattggattccatgccggatttgacatggcctggcgtacccttactgcttccacggtgtgggtagcaagtaacgcagcttcccgtttatcggggagttgcatagaaaattgaagggaggaatcctatgggacttattttattagttgaagacgagccgggcgcagttgcactcatgcgccggtacattgaaagcagctcatttgagcataaacttgcagcatttgcaaaggcggcagaggctttttcgtatgcatcgaaaaataaggtagatctgttcattttagatatacagcttttggattaccgggggaccgaactggcaaggcagctgcgctccatgccggagtatcggtttacgccaatcctttttaccacggagctggcaggggaggagttgtctgcctaccgggaaatcaaatgctacgatttcctggtaaaacctttcacggaggctgaatttcaaaggacattccaagcagctcttgagatgggggcgcagatgcaggcggctccggaaatccttcggattgagcagaaacagtttctgttcgaatatgaaatcagaaacatcctttatattgaatcgtttggaaaaaggcttttaatccacacggcacaaagtggaggaagcgaggtaaccgaccagatttctggttacagcctgttaaagctactggacatggtgccgcagaaccgtttgctgcaatgccataagagctttttagtcaatccggttcatatttataaaatagacaaggcaaaccgcctgctttacttggaggggtgcaaaacagcagtcccgattggtgagaaatatcagaaagcagtgtttgagcgtggacagccatgattatttctatctttttgcagagtgtattagacgggcttctcctgtctcttttaaacctcgggctgctgggccggtcaaggggaaagctggatcggctgattccgctgctgttcacaggtgtctgcctgctctcacgcctgggtcttggggaccacgacaccgacatggcatatgctgtgctcccggtagatcaaatcgtatcgtttctgttttttttcctcggcgtgctgttattaaacagtttgtggtttcaaaagagcgagggacatacgcttttcggtacggttgccgcctttgcgctgtatctcctgctgagggaactctgcttattgttcctggccctgtgcaatccggcggagccagtgtggtatctctatgcgggccgggcgctgtccctcggcctctggctggtgctttggggcacgggggcgctccggtggctgcgggagaagctctcggatggggatccagtcatttgtatggtctgcagcaatacggccctgctgcttttgctgctgctcctcctgtttcggtttgacttttctgtcatgctccgctggcttccggtgacggtgggagcggtggggatgctggcggtttgcgacgtgattgtcatgcttcttcggcagcaccgtgtgcaggcccggcggagaaccgcgatgttggagcagtatcttcctttggtggaggaactgattgaacaggtgcgggcgcgtcaacatgactttaacaatcagatgatggcagttgcagcagcggtttctgctgcacacgatttacaggaagcgcaggaagctgtgacatccctgcttcggcatgtaaggctggatggcgcggatagggaattattaaaatgtgacagtaaagtaatcagcggcctgctgtttggaaaaatgaaacaggccgagttaaaacaggtccgtgtggaagtgacggttgcaggcgcgtttctccgccgcgccttatctgaggctgactgggtggagctgattgccattttgctggacaacgccatcgaggccgcctcgccaggagatgtgctgtatgcccgggcaatagaggaagcggacagcctccgtttttctgttttgaatccccacgcggccctgaccaatgtggaatttatccagatgttccggcggggctggtcaacaaagggggaagccgggcatggatatggcctgtataatgtccgccagattgtggaacggcatggaggcaaaatcattaccggcaacgattggctcaacggaatcccctatatcaccattggggtattggtttcatgaaaatagaagcataggatgacaggggttttatgggcggaccgtttcgttcccataaaacccctgtttgttcccgcggtcttgtttttatgacggcagatgctaatataaaggtgcagataaataaaaatcaactggaaggaagtgctgacatgcgaaactttatattggaagggaagaagatagccagaccggtccttgtcacaacgtgtctcctcacgctgctgacctgtattctttcctgcactctttatcgggggtataccctccattttgaactcgacccatgggaaatcggcacggagtttttaagcctcttgtttcccctgtttgttaccataccgatttgctggcagctttactatgagcgccgggaccgttttctgacctacaccctgccccggatcggcagacgccgttatttggctataaagtggggggcgtgtgcattatccgcatttatcattcttgtgataccctatttcatctccgccctgtttgcgctgtatgtcagggcgccgcaggaactttggcccatacccaagggctatgcccacgttttctcaaacctttacgccaaaacgccggtcctctatgcattattgctttccctgtggaaggggctgctgggcgtcctgaccatgacctttggtttcgtactggccctttatggcagcaatgtattcatcatcctgacaggcccgttcatctatgtcatcttggagaatttcttttgggcaatccttgacgcgccgggactgcgctttgtaacagcctttgagcctgccagcctgagcgctccggcagtccatgccacatcattcatagcggggccggcgctgatgtgtattgtgatgggattggtggcgttttattatcagaaggtgaagaaacgctccatttaccaggtgtaatcccatgacgcgccatttatgtgggaaggccggcccggggaggtttttcctgctgtttggactatcccttctgttcgggctgagtgaacgggtgggcgcgcaaagctcacttccggttcatttactggcagtcctgaatgaccaatactatttcaccttcgctgtgctgcctgttttcctgtttctttgtaccggcgtgatggaggacgacacgcttttggtgctgacacggtatgggacctatggacgttactttttccataaatggcgggcgctgtcagtgattgcagccttgttttggcttggtcagatggccgcaatcctgctctccggcctggggcttccctgcgccggaagctggccgggagcgtcagaaggtccgtggcgggaggtatttacgctgctgcaaggaatcttcccgtcgccgtggtccgcaatcctttgctgtgccgggcagatacttctggggtactgcctgattgccctgacagccctttgcctgggccacttctgcagccgcgccctggcggtcaggctgctcatggcgttttatctgttggcagtgctctggattcagctgccggttatgtcccggccgccctttgtgtttttgaccggattcaaccattgggtctttctgctccacaatctggcctacccctggcgccttttgctgaccgctgtgaccacggcggttctggtggctggaatgctatggcttgtaacccgaagatggcgatggcggttttccgtttccaggcgcggtggaaaaggtctggcttcttattacctcaggggcctgtttgttgggaacaactggctgctgctgattggcctgatcctccttatgacggtttggacctggatttccaagggagcgccggaggatagtacggattggctgatccgcctgtttgcaggacacggcaccggatacttttacccgatgggacttttgatgctgctgacaatggaactgcttcctctgtggcccctgggagtattctgcacccaggtggccggggaacgctccgcttttttgacagtccgcctgcggcggcggaccgggcttttgggggcgcttctttataccgggcttctctggattcttgcgtatggctgtctgctggcccttggggctgtcattcctccatttctgctgggcttttctccggatatggggctgaccgcagctgtagtggggctgaaaattctggatgttacatttcaattcttaataatcctgtctgccctctgcgtgacggggcaggcaacggctggatttgtggctgtcctgctgttgcatttcctttgtctgctgcccatttcgtggctcccggcaggaatttccagcctggcgcggctgaaccttttgcagacaggaggaaccatcccgggagcggctgcggctgtgttactggcggccctttccctggtcctgatcctctggctttacagccggggcatcaagctgctgtttaatcattaaggaggatacctatggaacctattatttcattaaatcaagtgagcaagagtttttccggacggcgtgttctgtccgatgtatccctggatattgggaagggaagcaccgttggcatcgttggggccaatgggagtggaaagtcggtcctgttcaatattatctgcggctttttaatcccggacagcggacaggtttatgtgaggggacaggccctgggcaaggaacgagattttcctgaggacgtgggggtgctgataaactcccccggtttcatcggcctcaataccggattgcagaatctgcggtatctggccgggatccgcggcgtggccggtgagaaagaaatccgttctgccatgcaaaaggtaggactcgaccccgaggataaaacaaaggtggaacattattccctgggcatgagacaaaagctgggtatcgcacaggccattatggaaaatcaggatattttaattttagatgaaccttttaacacactcgactacaagacctacaatgacacgaaggagattatccggatcctccaggcagaggggcggaccatactgatgacttcccacaattataacgatttggaaacactttgcacccacatctataccatagatgagggcagactggggcttctatccagtgaagaaatgaagaagcagcttcgtggctgagtagaaggtgtgccattctgaggctgcagttgggaaatagacagcgccggcagatttatctttatggattcatatatggatggcatttggactgcaatcagataatacatggcctgctgtatttggctaaaacgcctatatggaattgattttgaaacaaagaaccgtcatatggaaagaagccacggaggaaggaaagggggcattaaggataatgccaataaccgattattaatagccaccaggctcattgtggcgattctgctggtggggatggtgataataattatccccaccttccaaagcggatagaaacgcagatgaagcggacaaaaccatagtggaaaccacggcagggctgcccggtgtattggaatagagcggaaccagccaggaggaggacgaagcttaccaaagcattacgtcctagagcgtgtttgaaaattaaaagttgcacaaaacatatgtttcactgccctttttcatgttaaaataaaagaaaaaggggtgttcgttatgttgaagcgatatgaactgactgaccaggaatggaatcaaattgctcctttattacctcctgaaaaatcgaaccggcctggccgtccttctaaggataaccgcacgatgctcaatgctatggtatggattgcacgcagtggcgcttcctggcgggatctcccggagcgttacggcccttgggagacggtctatagccgattccgtaaatggattgaggatggctttctggacaatattttccatgtactcagtcttgaggccgaattagaggagcttagtatggacgcctccattgtaaaagcccatcagcatagtgccggagctaaaaaagggggccagcaaatctgattggccatagccggggcggggccagcacaaaaatccatgcaatcgtagatgcttatggatacccagtctatctacggttgagcgaggggcagaggaacgatatcaatatggcaatcccactgttggaacaaatcagcctgaatggtagccaggtcctggctgatagaggatatgacagtaatcagctgattgattatatttatgaccacggtggggaacctaccataccctccagaaaaggtgcccggttcgagcgtcactgtgactggtggctttataaggaaagacatttagtagaatgttttttcctaaaactgaaggcctaccgaagaatcgcgacacgttatgataaactggccagtacctatctggggttcatatgcattgcttcaatcttaatttggttaaaatgactaaggatatataattttcaaacacgctctaggacagtactatattatttaaaaagcatatataagatgaataccactacaatggctattaaaattatattggcatatgactttttttcattataatttatgggaacataatcgtcgctgtcacggtgattggatacagatggctgtttatgattctttatatcctttgctttcatttttgtcggactcatggattccagttcttttttgatttcttttcgaaggaggaaatcatcatcaattatatggttgcatttgacacaaaatatatctttttcattgggaagatcgcttccgcagtatgggcattgtttcataaattatccgggtatgtgttcaatatatcccgtgtccccctttttcacatattattcattatcgacaaacttaatgtccattgcaatattaagagcttcacatatctgtaaaaccgtagacaattgtggatttgattttccgaaaatcttacttactgtttgttgggatacatttaaacgtgacgcaagatctttcattgggatgtctcttaagtccattatatgtttaatctcagacaacaattcttttggggtattatatatcatatccattctccaatcagcttataggctgattataaaacgtttgatgctgtttcacaacatataggtttaatgattgtgtattattttacaaattaagagctgataaataagctcacagggtgtataatgcaaacgtggaaataaagtaatcttggcctcggaccggaatcgagaatgtcagacaacgccttgaaacactgtgtggaggatacctgcggatacagagcgccgcagataagggaacacgggtaaggattttcctgaggctgaataaccggtaacctgcaggcggattaaccggatataccaggggcatccaattgtgcctgatacaagacaatccatacagaaaatacacaggattatcagacacaatctattgtagtggttactcctttttgatatacttataacagaattcacaacggagatacgaagtaggcaggccaagcagttttgttatgaggaggaccaatggatcgtttatcagatagattaaagggagcaaagctgacaccgcagcagcggaggatagcggactatttttttaaaaatcaggaacggatcggcaatatgtcatccatggatgtggcgaaggaaatcggggtcagtgacgcgtccatcatacgttttgccagggccatcggatatctgggctttacggatctgaaaaatgatatatataattccctgattggggaaaccagtgcatctgtgcggaacatgcagctgtcggaacggtttgatgtgctgacgggaagataccaggaggatgacattccgggttcctttgtggagatgatgaactataatattaccaggacctttcagcagaattccctggagagttatgaagcattagctgatatgatcatcaaatccaggagaaaatatgtagtggggctcagggggtgtatgggggtttccagccactttaccagactgctgggatttgcaattaagggagtggtccagatgcccggcagcagtgagacagaagtggtgggcgcgctgcaggatattgattcagaagatatattcatcttattttcttttgcacgttattataagattgatatgttgttggtgaacatggccagggaacataaggccaggatctgtgtggttacggacagcctgatggcgcccatggtccaatatgcggatattgcccttttagtggaaacatcacatatgagtttctttaactccgctattggggttgatatgattgctgaatacatcataacccttgtgtgccgaaaaaataaggatgaatatagaaagcgggcaaaagagcgtgatactgtgaccgaaggattccgtctggtattgtaaaatatatgaacgaattgttaacattttgtagtgaggtgacaaaacaagctgaattttcccggcttgttttttttgtgtcaatcttctggcacatatctgaaatgaaagaatttatgttaaaggtcagtaccttatccaattaacagcagcagtacagcctgttttgtcatctgtcatgttgttgtcagccgacagggggagactccacagcagggggagactccacagcagggggagactccacagcagggggactccacagcagggggggactccacagcagggggggactccacagcagggggactccacagcagagggactccacaccagcatactacacccttcttccttcgccttgcagacggacaaaatattcagtactgtcactattatgaaagacaggatggagcactgagaagtataagcaataaaaaagtactcatagagatacggattgatgatgtcgtaaacactacaaaaattaacattgttaaaaaatatactacaaactagatattgacagtagtgcacacaacaattatacttattgtacgaaatgaaaaacacactacaaataatccggataattgtagaatgcacaactttgaaaacataaacccagttaaacaaaaggagatgaagtaatgcttatttatttaagtgagtacatacatccggatgcggtccgcttaatcaggcagcgcgcagagataacggatagttttgaccgtatacaggatgtggatggaatcatattacgcaccgtccatataggacgggacatcatgtcccgggccgtgaacctaaaagtgatagggaaacacggcgtgggctgtaataccatagatttggccgctgcaaaggaattagggattcccgtcattaatactccctttgccaataccaattccgtagcagaactgattgtggggctgatgctggatataagcaggaatatatcggcgtgcgataaaagaagcaggggggaagggtttccatgtattgcgccgccggagatgacaggaattgaactgacaggcaagaccgtggggcttgtgggcatggggaatattgcccggcgtatgggggaaatcctgaaaaatggtttcaatgccagacttgtggggtatgatccgtactgttccaacgggcaggctgattcctatgggattgagaagtttgaagatttggaccatatgctggaggtatcggatattgtgaacatcagtgtcccgctgacgccttcaacagaaaacatgatttcttcagcaaactttgagcatttcaggaaaaatgcaatcctgataaatgctgccaggggaggcgtggtgaacgaggatgatctgtatcaggcgttaaaggagggaaggctcagggctgctgcatgcgatgcatttgttgaagaaccgcctaatggcaggaataagctgatgacccttgacaatttctgtgcaaccccccatatcggagccaatacagaggaagcgctttaccggatggggatggaggtagtggaaggggtatttcatgtaattgatgggatggaagtaaaaaaccgtgtggtatgaatgaggaggataagaaaatgaacaaaacaggatgcgtggttgttaaggattttaagcgcccggcaagggaactggtagagaagttcgcaggtgtggcagtggccaatctggatgactgcatgaaccgtatctcggcggtccatgaggatatatgtccggttaataagagctgtctgcttggtaccgcatttaccgtaaaagtaccggagggtgataacctgatgttccatgtggccatggaccttgcaaaaccaggggatgttattgtgattgacgcgggaggggatacaaggcgttccatctttggggaactgatggttacatattgcaggaagcgtgggattaatggtattgtagtagacgggtccatccgggatgcgggcgcaatggaggacctgacagactttgcagtatatgcccgcggtgtgacgcctgatggcccttataaaaatggaccaggggaggttaatacaccggttgtctgcggtgggaggaccgtatatccgggcgatattgtcctgggcgatgaggacggcgtcatattcatccgcccttctgaggcagaggagctgctgaaaaaggtaaacgcccttcatgaaaatgaactgaggataattgagacaattgaaaaagagggtacctatatacggccatgggtggatgagaagatgaaatcccttggtgtggaatatgtggaatatatggaattttaaaatggggtaatatcagaatattgggggtaatgttatgtttactacggcagtaaatgaattaatgtatctgtttctttttttgcttgcaggtgttgcgctgcgctcagtggttaagccactgcgtaagctgtacctgccgtcaggcctgattggcggggcgcttgcattggtcatgggaccgcaggtactgggacttattaaaatcccggaaaactggtccagcatggcgtctccgatgattaatattgtattgacaacaacccttttcggcatatccatcagcctttcaaagatgaagtcctttgcaggggcaatcagttccaacctgctgtcttatttttcacagcttgcagtcggaatcctggcagcattggggcttcagaagatatggacaggacttccgagggaatggggtgtcatgacggtctttacctactggggcggccatggggcagcaacctcttcgggaaccctgtttgaagaacttgggatagaagggatgttaagtgtcgggctgattcttgcgacgctgggattgattgttgccatggtggtaggaatggtatgggttaacatcggcgtcaggaggggatgggcaagggcattgccggatgccaagaacaaggaggatgaaaggaagaatgactatatacccagggataagcagaaaccgctggggcatgcaactgttgcttctgactccattaatggcctggcgctgcagatgtgttttgtattcctcagcatgtggattggaagcgtgattttcggtgcggttgcaaaagccatcccggcggccagcaatatcccatcccttctgtatggtattgtaggcgcaatcatcgtatggtttgtgttacggaaaacccacctggataaatatgccgatacggacaccatagacaatattgggggagtggcccttgaaatctgtatctgttcggcaacagcaaccctggacctgaattttttcgcaaacaatcttgcgccgatcatgattcatatgctggtggtaatcctgctcatgtcatttgtgtgtatggtcctcatgcgccgctggtttggtgaggactggttcccgctggcattgatgttcttcggcgcgggatgtgggtcgaccccgagcgggcttgctctggcacgatgtgtggatccggatgttaaaaccgaaagctgggaagcgttcggagtggcccagggatgttttgtccctgtcacatccaccctggttgccatacttcccgtaatcgcaatcaacaacatctggatattggtaggtatcgggaccgccatatcggcagcgatgattgcattcaatgaatttattgtcaggaagcggtagtgggggaacttccacccatcgagtctttcacagacgcgtttgcgcagaaccctttagatgattcatacttccttccagcaaggctgttttctatccataaaaccgttatcccttgggacagtgcgctccgcgcatcaggatgcactgtctggaggaggcagttttgggatgggaaaccgccttgttttttgtgtgcgcatttacccgtcatcactgctaaaaatacatttaaggatatggacgggcagaaactgaagggaatgaccggtttttatcccatgtatgattttgccgtcaaaatcggcgccggtatgggagtaagctgttcttttataggcatggcacaggtactatccaatattcaggcaataccggtgtggtgtgattcccttataccgtttaaatgttttgataaaatagcttacatcgctaaaaccacatcgataggcaacctctgtcaaggttaaatcagaggtacttaattcgctgcaggcgcgctcaatacgatagtagttcaaataatcaatgggggttctgtggatgatggaatggaaataactacagaaatatttgggagacatcccggcaatcctggacaattcgttcagtgtcatggccttcccgtaattactgtctatgtattccagcacaggtttaagctgcatcatcttcctggaagattttgtatcatcagccttatcctgataaagctttttctggtaaatgattccaaagatttcaaataaagtgcccatggttatcagctcgcttccaggctcgctgtgctgcatggatacgaaaagatggccgatgatccggtgcagggaacggttgctttttgtaaaatgattctggacaataatctgatgctttgtaatgaggcggatataaaaccggcaggtatctgtgtgcatgagaagacgctggatatcaaacacaatacattcataaatgcaattctggggcaaaccgccatgaataaccccctcattaataaaaatgatatccccggctttggcttcaagctcctcatcgtctaattttaaatagaggattccctccaaaatccggatgatttccaattctttgtgacagtggaagggcatgttataacggggatggtgcacgtccacatggtaatattcaataggaaagtccggggtcccgtgctgctttttttcattatagtccaaataatgcatattatcccctccttaagatggaaaaatgaccataaaaacagagagttacaacggataggtgggtaaaatgaccaataaaatgaatatcgtcatattttttgccattatatcacagcaaatagctgtatatcaatagtataatacaattatgtaaaaggaacacaaaaaatataataagagcacggataaattaaaaagaacataatccaaaaataagaaggaggacacactatggcagcaaacagattgatcggggcttatccggtcatcggcatcagacccacaatagacggaagacagggatatatgaaagtaagggaatccatggaaggacagaccatgaatatggccaaaagcgcggcggccctgtttagggaaaacctgtgttacagcaatggggaaccggtaaacgtagtgattgcggattccaccattgggcgggtgggggaaagcgctgcctgtgcggataaattccgcagggccggagtggatattaccctgactgtgaccccatgctggtgttatggtgcagagaccatggacatggacccgcatacaatcaagggcgtgtggggatttaacggaacggagcggcccggcgcagtatatctcgcctctgtactggctacccatgcgcagaaggggcttccggcttttggtatctatggacatgatgtccaggatgcggatgatacaagcatacctgaggatgtaaaggaaaaacttctccgtttcggacgcgccgcagtggctgccgctaccatgagggggaagtcatatctccagataggttctatctgcatgggaattggaggttccatcatagacccggcatttattgaggaatatctcgggatgcgggtggaatccgtagacgaagtggaactgatccgccgtatgagtgaggaaatatacgataaagaagagtttgaaaaggcccttgcatggacaaaggcaaactgtaaggaaggctttgacaagaaccctcccgaggtccagaaaagccgggaacagaaggataaggattgggaattcgtagttaagatgatgtgtatcatcaaggatttgatgaatgggaatcccaatctgccggaggggcgggaggaagagcggatcggacacaatgccatcgccgcaggcttccagggacagaggcagtggacggatttttatcccaatggtgacttcgcggagtccatgctgaattcctcctttgactggaacggcgcaagggagccgtacatactggctactgagaacgacacattaaatgggctgggaatgctgttcatgaagctgctcaccaacagggcacagatttttgcagatgtgcgtacgtactggagtccggaggctgttaagaaggcggcgggatatgatctggaaggagtcgcaaaggaagcaggcggtttcctgcatctgatcaactcaggagcggcctgtctggatgccacggggagggccctggatgaagacggacagccggtcatgaagccatggtatgaggtgacggcggaggaccagaaggcaatgctggaagcaaccacatggaatgaggctgattttgggtatttcagaggcggaggctattcttccagatatgttactaaagcccagatgccatgtaccatgatccgcttaaacctggtaaagggactgggacctatgctgcagattgcagaaggctggaccgtgaaactgccggaggacgtaacggatatcctatggaagaggacggactacacatggccgtgcacctggtttgcgcccagggtgacaggccggggagcatttgcctccgcgtatgacgtgatgaatcactggggagccaaccacggtgcaatcagctacggacatattggggcggatctcattacactctgctccatcttaaggattcctgtcagcatgcacaatgtgcctgaggaaaaaatattccgccccgcagcctggaacgcgtttggaatggacaaagagggacaggatttccgggcctgtgcggcttatgggcctttatataagtaaggcggtgtgtctatgaaccataaaaatgtgctggcagtggatttcggcgcttccagtggaagggtaatgctgggaagctttgatgggaaccggatatccatacaggaaatccatcgtttccccaatgatccggtcatattaaacggaaccatgtactgggatttcctgcggctgtttcatgaggtgaagcagggactggtgaaagccaggaagtatggaaagcttgacagcatcggtgtggatacctggggtgtggatttcggcctgatcgacaaggcgggaaatcttttagaaaacccggtacattaccgggacgcccggaccgcagggatgcttgaaaagagttttgggaaaatggataaggaccgcttttatcagattacgggcaaccagttcatggagattaacacggtattccaactcttggccctgctggaacagcggcccgggcttctggagggaacttccaggcttctgttgatgccggacttatttaattattacctatgtggggcgcaggtcagcgagtactccatcgcgtccaccacgcagatgcttaatgcccgtactaagatgtggtcaaaggaagtgttggaaagcctcggcatcccggaacggatcctgtgcggcatcgttccatgcggaacaggacttggtcccatgaaaaccgggatctgccaggagctggggattgagcctgcaaaagtcattgccgtggcaggacacgatacgcagagtgcgcttgcggctgttcctgccagggataaggatttcatcttcatcagctgcgggacatggtcgctgtttggcacggaactggacggacctgttatcaacgggttgtcagaacggctgaatatcacaaacgaaggcgggtgccagggaaggatttccttcctcaagaatattatcgggctgtggctggtccaggaaagcaggagacagtggattcgtgagggaaaggagtacagtttcgggcatctggaacaaatggccgcagatgcaaagccattcaaagcgctgattgatcctgatgcgccagagtttgtcccggctggaaacatacctgagagaatccggggatactgccgtgaaagcggacagagggtgccggagaatgaggcggagcttgtgagatgcatcgatgagagcctggcgtttaagtaccgcatgacattggatgaaattaagatgtgtaccggaaaggagtacccggccattcatatggtgggtggcgggacacagagcgggcttctctgccagatgacggccaatgcgtgtcattgcccggtgattgccggaccggtggaggctaccgtactgggcaacgcagccatgcagctgcttgccacaggggaacttagggatctggatcaggtgagaagtgtggtaggggcttccgccaaggtaagtatctatgagccgaaggatacggatcagtgggagcaggtatacggacaatataaagaaatgcttgccgcagactgaggtttattgcggtgggatggcagcatatgaatgaccaaaggccggggtaacccggcaaagaaggaggtattatggaattaagctatatggaactaagggaacagatctgcgatgtgtgccataagatgtggcagcttggctgggtggcagccaatgacggcaacgtgtccgccaggctggatgacggaacctttcttgccactcccaccggaatgagcaaaagtttcattacaccggaaaagctggtccgtattgatgggaaaggtgaggtgttggaaggccttcccggatacaggccctcttcagagattaagatgcatctccgctgctataaagagcgtgaggatgttaattccgtgcttcacgcccacccgcctgtggccaccggatacgcggtagccaatgtagcgttggacgagtattccatgattgagacggtaattgccctgggttcgattccggtaacgccttacggaaccccttccacttacgaagtaccggataacatagcgccctatctgggggaacatgacgcaatgctgctccagaatcatggggctttgaccgtgggggctgatgtgattaccgcttattaccgcatggagacactggaactctttgcaaaaatcagccttaacgccagaatgctgggaggtgcacaggagatatccagggaaaatattgaccgccttatctcaatgaggaaaggatatggggtaaccggcaggcaccccggttataaaaaatacagtaaacagggggaagacagatgctgagaggaataccccatatactatctcctgaactgctaaagatattatgtgaaatgggccacggcgaccggctggtgattgccgatgggaatttcccggcagagtccatgggcagggatgcccatgtcatacatatggaaggacatggcgtgccggagatactggaagcaatccttttgcttttccccctggacacctacgtaggacagcctgtctgcctgatgtcggtgatggacggggatacggttgaaacaccaatctgggatcaatacgtgacattggtgcaagcgtgtgacagcaggggcagaagtgccgtgggccatatggaacggttcaggttttatgaggaggcaaagaaagcttatgcgattatcgccaccagcgagcaggcgctttatgccaacatcatgctgcaaaaaggggtagttaccgaccagggcctgtaaatgggttccgccaaaactgttcaattagtaaagaaacggaaggtgatgatgtgggagaagtaattctgaccatgaaagacattgataagtcctttgtcggggtacacgcgttaaaaaatgcctgtctggaacttaaaaagggcgaggtccatgcactgatgggtgagaatggcgccggaaaatccaccctcatgaagatattgacaggaatctacagcaaggacagcggtaccattgtgtatgaggggcgccaggtggagtttaaaagtcccagggaagcgcaggacgccggtattgtgatcgtgcatcaggaattgaacatgatgaaccacttaacggtggcccagaatatctttatcggcaaagaaaaaatgaacggaaagctgattgatgaccgcaggatggcggaagaggcagaaaagctgttcggattactgaatatcaagattgatccaagggaaacaatggggaggctgacggtggggcgccagcagatgtgtgagatagccaaggcaatctctactgatgcaaaggtaatcgtatttgatgaaccgactgccgcgctgaccgattccgaaatcagcgagctgttcaaaatcatccgtgacctgagggccaaggatatcgggattgtatacatttcccaccgcatggatgagatcaaccagattactgacagggtaacggtcatgagggacggggaatatgtgggtacgctcataaccagggattccacgaaagacgacatcatccagatgatggtagggcgcacggtgtatgaggagcctaagagcttcagcaatgtaaggccggatgccccggtggtgctgaaggttgaacacctgaatgttggaaaaacagtaaaagacgtaagctttgaactccgcaaaggagaaatcctgggtttttcaggactcatgggagcaggaaggacggagacggccagggctatctttggtgctgacaggagggacagcggcgatatttatgtgaatggaaaacgggtggatatcaggaacccacaggacgcggttgacgctgggatcggatatctgtcggaggaccgcaagcgctatggcgtgataatcgagaaaacagtggctgagaacacgacaatggcttccctgaaagcattctgcaaaggcatgtttattgacaagaaagcggaaaaagaaacagcggaacaatttgtggaggcgctgaggaccaagacgccgtccgtggaacagcaggtgcgcaacctgtcgggtggaaaccagcagaaggtggtcattgccaaatggcttaccaggaactgcgacatcctgatatttgacgagcccacgagagggattgacgtcggggcaaaaagcgagatttatacattgatgaataatcttgtaaaacaggggaagtccatcatcatgatatcctctgaactgacggaagtgctgcggatgagcgaccggatcctgattatgtgtgagggccgtaaaacaggagaaatcagcatagaagaagctacccaggaaaaaatcatgcatgccgctacactgagggagtaaaggggaggttaaagacatgtcggataataagaatcaggtaaaaaaggagccggatggattgttcaaggccatcggcactcagaaattggtggcagtgatcgcattgattgtattattcatgttcttctggatttttggggacaattttgcaaagtacagcacactggtcagcatttttgattcgtcatattatattggctttatggcgataggcgtgacatttgtgatcatcaccggaggaatcgacttatccatcggcacggtctgtatctgctgttccctgatttcagggacgttgtatacaaaactgggactgcctatgccgctgtgcgttatcctggccatactgatgggaggcctgttcgggcttgccaatggacttatggtatctgtcatgaggcttccggcctttattgccacactgggaaccatgatgattaccaggggcctgggctcaattgtgacaaacacggcgaccgtgacatttccacaggcttccgccccaggcggctcattcagaggcattttcaagttaaagggtgcagggcttccgcaggccggtatccccacgggattcatactgctgattgtactcgcaatcctgatggccatccttctcaacaaggcgcgtccgggacgctatatactgtcccttgggagtaataaggaggcgacccggctttccggtgtgaatgtggtaaagtgggagaccttggcttatgtcataagcggtctgtttgccgggctggcgggcgtgtcttatgcggcagtatactccacactcatgcctggaaccggaaatggatttgaactggatgcaatcgccggagtcgtaatcggcggaacatccctggcaggcggcgtgggttccatatcgggtactttaattggtgtttttattatgtccgttttgaagacaggccttccctttgtgggggtacagccacattatcagctgctgattacgggatttgtattgatcatagcagtatttgtagatgttttaaatagaaggaaacaggggaaggattagtacgcaattgctaataacccgcaaagcgggataaaataagggaggattattcatgaagaaaaaattattaagtacagtcatctgcgcagcaatggtgtccacgatggtaatgggctgctccagcggagccagcgcgcccgccacgacggccgcggcaacggccgctccggagacagaggtaaaggacacgacagcaggggatacggaggcagccaagccggatgggactgtggattacagcgatgtcacggttgagattgtggcaaaaggcttccagcatgatttctggaaagcggtaaagatgggatcagaacaggctgcaaaggatttggggcttaagtctaccaattttgtgggtccggccagcgagagtgcggtcgctgagcagattgagcagctgaacaatgcagtcaacaaagcgcccagcgccatctgcctggctgctttggacacacaggcggccctggatgctatctccaatgcccaggcagcaaatattccgattgtagggtttgactccggtgtgccggatgcccctgcaggcgccattgtagccaatgcagccacggacaactatgcggcaggcggtctggctgcggagaaactatatgaaatgattaaggacaaggtcacggatccggcagaagcggtcaggatcggcgttgtctcccaggatgccacatcccagtccattggggaacggaccggaggtttcatagacaggatgtgtaccttaatcggtgaggataaatgcacggtagtgggccatgataagtataacaaggcagttgacggagcaaaggtgattatcgatgtaggcattccggcaaccgtggatgatgcggcttgcgtgaccgtggccaataccctgttgaataaaaatgacctgattgccatttatgcgtccaacgaatttacagccaagaacctggtgacggccaatgagagtcttcaggtactgggggcggataaagtaatcggcgttggattcgactctggtgccatccagcttgatgccatcaagagcggtgtcttagcaggttccatcacgcagaatccggtacagattggatatcaggcggttaccctggccgccaaggcagccaaaggagaaccggtagaggatgtggacaccggcgcgctgtggtatgacagcaccaatatggattcagcggaagtggctccgtgtctctataagtaatattttatagaggtatcctgattttttgaggttttcagataatagtcctgcatggatggacattaataatgtggaaaatccctgatttctttgattagcgaagaaatcagggattttttctatttaaattgagatagctatggattttccgaaatcccataccggcatttggacagaacagttttattgtttgttccgaaaaggataaaagaatcgtattccagttcctcataggagaagcaatcgcagggaaaatggattataatcggaactatcaaagctttgtaagattttatgctgagagggggatgatatacagttgatggtgagaaaatgtgctggttccattggggaattagtcgaaggacctatgtggtgtaaaaaacggaatagtttattttttacggacatattaaacggcactgtctttgaatatattccgaaaactgaaaaaatccagcattggaagctggggacttatgttggatgtattatacctggcagggaccgtgatgaaatgattgctgcggttgacgattgcctgaaggtgtttcatccggaggacggcagggcagaaaccctatgccgctttcccatggcagatggtatccggttcaacgatggcaaatgcggaccgggaggacagctgtggatagggacgatggcagtcagcgggcagaaggacaggccggacggcgggctgtaccggattgggccggacggccggacctgctgtgtggagccgtccctggcaatcccgaacggaatggcctgggatttggaaaagggaatattttaccatgtaaggacggaggagcaggctgtttattcttatagctgccatcaggactggcatacgatacggaatcccaagaagtccgtggatttatccggtgagaaaggtgttccggacggaatggccatagaccgggacggaaacctgtggattgccatgtggggaggatacaaggtcatctgtgtcaatccggcgtccggcatgaagctcatggaggtggcgctgccggatgctgatgtatccagctgtacctttggcggtggacatctggatgaactgtacatcacgactgccagggaaggacaggccggcggcaatgtctatgtggcggatgctggggtggcgggaacatacccctatgaattttgttggaaagaagaggaagaaaaatgagacgaccggcagctttaataacgggggcggcaaaggggataggaaaacagattgccattaccctggctgaaaaaggttatgacatagcggtgaattaccatacggacccgcaggcggcaaaggaagtctgccgcgaggcggagtcctttggggccaggacgctggctatttatgcggatatgtcaaaggttacggacataaaggcgatgcacggccaggcagatgaaacctttggaggagttgacctggtggtgaacaacgcgggaatcagcagcgaggtgtatttcctggatgcagaggaaaaggattttgacaggatgacggcgattgactggaaagggctgtacttcagctcccaggaagcggctaaaaacatgatagcccgcgggattcagggagtgatcatcaatatctcctccaatcagacggatgggtgctggccaagggccaccatctatgggcctaccaaggcggcggtgtcaaagtttacgaaaaatgccgccatggagctggccggatacggtatacggatggctgcggtagccccagggtatacggatgtgggctgggagccggatgatatacggtgggaggcggcgaaacgcctgccttttggacggtttgcatccacaagggagatagccgaggccgtggcatatctggcatccggacacgcggcgtacataacaggcaccacccttaccattgacggaggggcaacgttaccggtggtagcggccaatgatttcacatgaggttgaagaatggaagatgaacgttattacaacagattattaaagggggaccagggggctttgaagcgcgcgctctataaatccatgggatttacggacgaggccttgcaaaaaccgctgatagcggttgtgaattcctacaccaatgcaacgccgggccactataacctgaaccagctgtgcggacaggtacaaaaggggatagaggccgcaggtgggactgcaatggtgttcggcaccatcgcaccctgtgacgggattgcggaaggtcatgacgggatgcgttatgtgctgccttccagggatctgatagcctcctccgtggagtgcatggtgagggcccaccggtttgacggcatggtcctgcttggctcctgtgataagatcgtgccgggtatgctgatggctgcggccaggatcaatatcccgtccgtgttccttaatgggggaccgatgtatccggctgtttataaggaaaagcattatgatgggaatatcgtgaccgaggcggttggatggaaacagcggggcgaaatcacccaggaggaatttgagtacatagaaaatatcgcggagccatgcgccggttcctgcgcaatgctgggcacggccaacaccatgggatgccttgcggaagtgatgggtatgtccctgcctggcagcggcaccgtcccggcagtcctgtcccggcgtctttccctggcctatgagtcaggacgcgcggtcatggaacttgtgcacaggggaatccgtgccagggacatactcacaaaggaggctttttataacggcatcacagctcttatgggcatgggcggttccaccaacgccatcatgcatctgcaggccatatacaaggaggccgggctgggcagcctgcccctgaccgtatttgacggattcagcaggaaggttcctcaggttgcgtccatataccctgcctcaccttatgacatggtggatttttatgaggcgggaggcgtcccggcgttgttaaaagagcttcaggagttcctgcatgagggggcattgacggtatccgggaaaacagtgggggaaatccttgcagggacccagcctgccagcagaagggaagtaatcaggacagcatcccatccgtttaacagcaatggaggggtggcaatcctgacgggaaacctggcgccccttggaagtgtggtgaagccggcggcaatcccttcccacatgatgcattttgaaggccgggccagggtgtttgcaagcgagcaggaggccattgacggaatcctgtccggcgatgtaagggaacagtccgtggtagtgctcagatatgagggaccgaagggcgggccgggtatgccggaaatgtaccgtcctatgaaatgcctggagggaatggggctttcaggaagctgcgccctgattaccgatggccgtttctcgggttccaaccgcggatgctttgtgggacatatatcgccggaagcgtttgagggcggcctgctggccgttgttgaggacggggaccgcatcattgtggatataccggacaggaaactgacgctggacgtgcccgaaggggaactgcgtgagcggatggcacggtggagcgtgccggagaaacagatagaaccaggatacctggaaacatacaggaaaatcagcagatcagcagcccagggggctgtggtggaatgaggaggatgcagatgcagtggtcggatgacaaggaattatttgggaaaatgagggaagtgttgtattcagccgtcataggggatatattggataagatgcattattaccatcaattccttccgtggaggatacagcccctggataagggcatggtggtggccggcagggccatgaccgtcctggaggcagatgcctttgaggacgtatcggattcccataatccggtgatgaacaagccgtttgggttgatgctggaagctttggatgatataaaagaggatgaggtgtacatatgcacgggcgcttccccggattacgcattggtgggggaactgatgtgtacccgcatgcagatcctgggtgcggcgggagctgtggtaaatgggttccaccgggatacaaaaggaattgaggaattaggctttccgtgtttttcctacggaagatatgcgcaggaccaggcgcccaggggcaaggtgattgactacagggtgcccattgagatagaaggggtacggatccgcccgggggatatcatattcggggacatggacggggtggtggtcattcccagggaaattgaaggggaggtaatccggcaatcctatgaaaaagccacgggcgagaagaccgtgggggaagccattaagaaggggatgcctgccaaggaagcctttgagacgtacggaatcatgtaaaaaacaggatggagagggataaaaaatggagaataaaaaaagggaaatacgcacagccaccaatggacaggcagtatgtgtggttgtattgattcttgcatcattgataattggatttacagtcctgaaggttgatggtatcatcatgttaaccgtggcagccgtcatagcgggcctgtttgcactttatctgggatattcctgggatgacattacgggggcggtatcaaagaagatagcggaagccatgcccgccatattgattctgctcagcatcgggcttttggtagggacctggatggcaggaggcgtcattccggccatgatttactatggacttaagattgtaaaccctaacttcctccttttgaccgcattctgggtcagtgtgttcatttccattgccacaggcacatcgtggggaactgtgggaaccatcggcgtggccctgatcggagtgggagtggggctgggtgtgcctcttcccatggttgcaggagcggttatctcaggcgcatacttcggggataagatgtcacctctgtcagataccacgaacatgtccgcattagctgcaaaggctaacctttatgaccatattaagcagatgtttgtcacaaccataccggccatgatcatagcctgcgttgcgtttacagtcatgggactccagtttaaatccagtaccattgattcagagatatataccaacatgctcagggacctgtctgccaatttccgtttcagcccgttccttgtacttccgccagtccttgtcatcggcggcgcaatccttaagaagcccactgttccggtgttgatcctgtcctcggcagtggccatggtgctgggactgaccatccaggggtttggtcatgacattgtattcacggcagctaaatccggtttctctgcggcggctgcatttccgggaaaggagctgtcaggggaaatccttaccctgctcaaccgcggcggcgctgcctccatgttcgagggcgtcatctatgtcattatagcctttacctttggcgggatcatccagctgaccaactgcctggaaatcgcccttaagcatgtcatgaaacccttgaagagcattacctccgtggtgaatgcggccggtttttcggctgccgccattgtagccattgcgcagaattcctacatttcctatttcctggtagcggacatattcggaaagaagttcgaggaactggatctgaaggaacagaacctgtcaagggtactggaggatttcgtgacagtgacggaaggtatcatgccgtggaccatatccggtatctatatggctaccactttgggggttgcaaccattgattacctgccgttctctatatttaactggtcctgtaccctgatgtcaatcttctatgcatgtacctataagagtatcgggaagtttgcattttcctataagacaggaaaaagggcggggatagatgacaggaaagcggcagcacaatcataagaccacggatgttattcagaggagaagaaaggaagcagatcatgaaacatgtaaatggaaatgaatggaaggatgcggccatatgccagcactattttgaggataacagcaactactatggggcggtcacgccgccgatcgtgcagaccacgctgtttacattcgatacatttgacgcattcattgaagcaagcaaccatgaaagggagaaccatctgtactgccgcggggtgaatcccactacggaaatcctggagaagaaactggccagactggaatgcggggaacaggcaaaggtgttcggttccggaatgggggccatatcagccacattatttacccttttggaggcaggcgaccacatcctgctggtgaacaatgtatatggaccggcgaccatttattcgaagaccctggaaaagttccatgtggaatgtacgaatgtgtttgtccaggatgccggggaaatagaacagtatgtgaaaccgaatacaaagatcatttattatgaaagcccatccacccagatgatgtacatgctggatatcgatacgatagtggatattgcgcggcgccatgacatccttaccatgacggataatacatggtcaaccccgttttaccagaaaccgcttacccatggggtggatatcgtaatccattcctgcacaaagtacattggcggacacagcgatgtaatggccggggctgtcatatcaaggcatgagatcgtggaccggatatttgagatagggcaccagtttagcggcgcggccatcggtcctttcgaagcctggctgctgattaggggactgcgttccctggaggcgcgtctggaacaccaggcccgtaccacacaggccgtagtggaaatgcttaaggaccatcccatggtcaagactgtgaaccatcccctctgttttaccggaaaacagaaggaactggcagacaggtacctgacagggtatacaagcctgctgtccatagaccttcacacagatgcctttgaggatgtgaggacagtggcggacgcatgtgggatattccagatcggggtcagctggggcggatttgagagcctgatcctgccccagaaccatggcgataatgaggcgtatctgaaggaggcccacatccctggcggattgatccgcctgtatctggggatggaaccggcagaggacctggtaagcgacctgaaacaggcgctggataaaatcatgaaataaatcttggatgtgttcctggaggcaggaggcgcgggcaggttgccgtgcctcctgcctgtggtggcagaaaggagatggaaggatgcgtatggaacgggcggaactgatggagctgatgcaggacagggattataggacggacatctataaggtgggcgtattccgtttcccatccagctataagtttgagcgccatgaacacgaggaaattgaaattaattatgtggccgcgggctgctgccttatggggattggggatgagttcgtgcccatgaaaaaaggggaatgcatcatcatttaccgccatacgccccattccttcatggtgaacctgaagcagagctgccgtctgacacagctggagatgaagatacaggttccggccaggcaatatgaaaaccggtttttgaatgaactggggggaggacggcagtacaggaaatgctccaactgcgagtccatctgcgattatatagaaatgatctgcagacacaaaaatgccgcacatccggatggggcgggccttttgcagatggatctgcagctggccgcgctgtatgtatccctgtcggaaaagtataaggaagaggaccggtatgtaccaagaaagaacgacaggtttgggcagattgtacagtatatcaatgataatttcacggaagtaatagacatggaacggctcagcgtggattacggaatcagttcccggtatataaggaagcggttccaggaggagattgggatgaacagttcccagtacatcaacacattgcgggttaataaggcaaaggaattactgtggaatttcaatctgagcataacggatatagcaagcctgacaggattcggcaattcccaatacttttgcaggatttttaaaagctttaccaacttgacaccggtaggatacaggaagctttggtccggggatgggaagcggaagtaggatttaggcacgtgggaccgtgtaaaattaaagacgggatggatatggcctgatagaaagacggtgggagcatggacggacatgccctcaccgttttttacagggaatctggtgggggtatgtggccggcatttttctaccatttggagatacaggcttgtacgataagacataataataccccatccctcttgcagggatatgataacggatataggaatgggagggggacttatttcccgccaatatagatttttccgttatgttactatataattgttgttatcaggaattacttacatagctaagatttctatgtagcagatgaaagatagagggggggatatccatatgggattttttgataaaatgaaggaacctgttttcctgaaggagagcagtgacgcgcagagacagctggctgtgttaaaaaaattagaaccgcagctgtccccggaaggacagaagaaaatacgccaggacataaagtttttggaatatggtatcctgggggaaaaccagattgcatatgaactgaaaaatagtcatatgcctatgtatatcttgcatgatatttatctggaagctggggatttgagtgcacagatagattatattgtggttaccaggaaaatgtgctttttaattgaatgcaaaaacctgtttgggaatattgagattaacagcaaaggagaattcatccggacattggaactaggcgggcggaaaacgaaagagggaatttattcaccggttacgcagaatgaacgccatatggatcttctgaaattcataaaaaccggaactaaaggaaatgtagtgacccggtttatggcagacaagtattttggggatttttataaatctgttgtggtgctggccaatcccaagactgttttgaatgccaggtatgccaaaaaggaaatcagggaaaaggtgatacggggagaccagttgattgcttatataaaagagcaatataagtcatctaaggaactggaagattctgatgacaagatgaaaagctgggcggaatcatttttgaaattacataaggaagttgagaaggactatacccaaaagtatcagcagttcatggtggtggattcaggaaaaacggaggaggggaatgggagtaaaacggctgacggaaacacggaactgtgcgataaattaaaggcgtatcgtttagaaaagagcagggaagaaaagataaagccttattatatatttaataataatcagttggcagatctgattgcggcaatgcctgcatcaaagcaggagttacagtctgtccccggttttggaccggttaaggcagggaaatacggggatgatattttaaatatcatgaagggatatgcaggacaggaccctgaagcagaataagcgggggtaatgaaaaagctgaaataaagggatatacgatggatagcttttgagcagtattgtgacgaacaggaaatgcccttttccaaaatcacgcccaggtagaagctgaaacctgaagtgctcttgcagctttgtatcatgtatggcgcaattacgggtatgctcagtgaacgtccgcatctgacatttaatattatatgccaccaacctttgcgcatgttgattctagggcagtatcatatcccattttacaggttcgcaaccaatagcagtgcagaactggagcagataggtcaatttctggacacttatgggcaggcatgaaaagggaatgacgtggaattacctgtctccaggccatttccggtgaccggactaaccccattgcctcattgttgtgtaccatatatattcccgtaaccggattgcgttttacaaagaaataaggtataatggacaaagcattaaatgagcaggactatacctgaacgaacgtgaaaagtaaatccatatacctgccgctggtctctccggaaggggagacctttcctctatcctgtagctgtatgcagggaatgcggaaccggggtatatacagggatgaaaacgggaaaaatcgtgggataagccggtttatataagctgaaagataaaagtacagccttgggggattgcggggaaggatgctgcaaaaggctgatgggggttgaatatgaaacgttttttgaaaagtggactggttgtcctgttcctgctgcttatgctgtttggtggaatgaccctgcatacggtgtcgcagtcccagcattacagccggctggttaattatgtggggattgtacggggagccacccagcgcctggtgaagctggagctgatggaccagccgagtgaaccgcttattgaatacctggacggaatccttaaggaactggaaacaggggacggcgagtatgggctgccccttccaaaagacagcaattatcagcagaagctggctggacttagcgccatgtgggaagaaatgaaagtccagatatcagcctaccgcaatggcctggatgacgggacaacccttctgtccctgagtgaagcctactttaagcaggccaacgacacggtttttgcagcggacgaatatgcggtaaggtgtatccagggactgaatgtaatctgtatcgtaatgcttatcatcatgctgcttacatggctgttcatcatatgggcctactggaaaaagctgctgcacctggaggataccaaccaaaagctgaatgacctggcccgcagggatacattgaccggcgtataccagctggatgcctttaaggaagaagcccagcggtatctggatgcggggcatgacgggaaaatagcgtttgtctatacggatttttcagatttcaagtacatcaacgatgttttcgggtatgcgtacggggacagtatcctgaaacggtacggggaaatattaaacaggctggtgggggatggggagctttgcggacgcgtgtcagcggataatttcgtccttctgctccgttaccaggaccgggaagaggtggcggcaagacagcgggaggcggatacggaaatcatccgtttcatgcacagttcccataacaggcagtccgtgcccacctgctgcggcatctgctgtgtggaggacgtcgtggaggatttgaggattgacggtttcctggaccgggccaacttcgcgcgcaagacagtgaagaacggaacccattccaactatgtattttatgatgagagtatacgcaaccgtctccgtgaggaaaaaaatgtggagagcagtatgctggccgccctggaaaatcacgaatttaccgtgttttaccagccaaaggtagagctgggcacgggaaagatagcctgttctgaatccctggtgcgctggaagtcacagagcggttccatcattcccccggaccggttcattccggtgtttgaacgtaaatatatgattgaccgactggaccagtatgtgtttgaagaagtctgccggttcttaaacggacggctgaaggcgggcaggcgtgtgcttccggtttccgtcaatgtctcacggcttcagttttttgaccagaacttcgtgaaacggtatgtggaaatccgggaccattaccagattcccgccgaattgctggaaatcgaatttacagaatccattgccattgacaataccagcctgctgaccagtattgtggatcagctgaagcaggccgggttttcctgctccattgatgatttcggcaagggctattcatccctgagcctgttaaagaccttgcccattgacgtgcttaagatagaccgctttttcttttcggaaagcaatgaccctgagcgggatatggccgttgtacaggggattgttgaactggtccacaagttcaatatacggacagtggcagagggcgtggaatccgaaagccaggtggagatgctgaagcagattggatgtgactatgtccagggctatgtattctaccgcccggtaccccaggcggagtttgaacggctgctggacggacaggagtaggcttgggctgtttcagccgaattgctttgatgaaggatatggaaaaatgaaacagaataagaggcgcagattttcatagatatgcagcagcgaggccggaaacccatgacaatggatataccggccttttgtatttttatttatatgtgtatcattttttacagacaatcaaccgccgtccttttataatggggatgcagcgtattaggaaggaattaaaataccagtacggccttgcgcagataccagggcatcgcaggccgctgctaggagcgtgtctcctccgaacaatacgtttccagggcaggcaggtcagttacctggatctgtttcctctgggtgaggatgatgtttttttcccgcagttccgacaggccgcgtgccacatggacccggctcaggcccagtatatcggcaatctcatcctgggtcatgtcaatggctgaggaggaacaggataagcggttttctgtcagaagatataataggttgcagattttcataagggatgtattgtattcctgatgtgcggattcaaacaggaaccggttcacatacatggcataccaatccacgaccttttcgctgaggtctacatttgtctcaaacatgttttggaatccgtcctttgtgaactctaagacctccatatccgtgagggcttccacgataagggaaagttctatcttgaaatccagccggtgatagccggggaagacggtgccgctgccatggaagctgatgattttcctatggccgttttcgtgattgacatagtgcatggccatgcctgaaaggatgtaatatatcttaccgtggggctggtttggcttccagagaaagtctccttttttaaaggcttttttctgatggggctgggaaaggaaatatccatgaaacgggtcataatcatgagcaaaataataacggggagtctgcatggtaccacctcggcatatgtgtaagttaagcttactataccatctggaggaaatatttgcaatttcaaacacgccctaacatgcggataccccagggtaaaagaaaatgaaaggatgggaagaatggaacacaggtgtaagattacggtaatacgcaaggagtgttatgaggatttacaggagcagtatctggcggacccgaagtcaggcccatgccccatgtttgaagttggccaggagttcattttagagcggaatggggacagggacgatttctggcatatgctggacgggaaattctgctctgaggcatgggatgccgtcagccggtatgtgtatacggccctccagggcggctccatcatgaaaggctggaccaatgatgagaagatgatgattgcatgctgcaatgacgggacccgcccggtcatctttaagattgaacggatggatgtccaggacgtattgtgaataatagacaaaaaaccaccttataaaatagtaaaaacactgaatctgaaattaccactagacaaatctgtattgaaggtgctatagtgatttcagaaaaacaagtttgttattacgttagggtaagcaagactgtttatgatactttgggtagtattataagcagtttttttatttggcggggagttggattatacgctcccatgacatgccggttttatggaggaagggtcattgaagataatcagagtcctgaacacaaatgcagttgtaacgctggataaggacagacgggaggtcattgtcaccgggccgggaatcgggtttcagaaaaagaaaggcgaacagctggccgaggaattaattgacaagacatactgcctgcgaagcggtgaggacagccgcaggctccagcagatcgtccagtccgtttccgagcagtacctgggcattgcagggcgggtggtggatgcggcgaggaatgaggggctgaaggtgaatgacgtgttatatatcacgctcaccgaccacatcaattcagcagtggaacgcctccggtccggcattgccctgaagaacatgatgaagatggatatgcgcaggttctatgaaaaggaatatgccatagggcaaatggcggtgggctgggtccttgaggaaaccggaatagacctgggggatgatgaggcggccttcatcgccatgcacatcgtgacctcggaactggataacagtaagatgatggacatccagaagataacggagctgatgaacgctatcctgcagattgtcaggttccattttaagattgagttccatgaggactctgtttcctaccagcggtttgtgacgcacctgaagtttttctcagcaagggtgtttgaccacggggcttaccaggacagcatgaaagaaatctaccaggtgcttgtggcccagaatgaggaggcttattccggcgtcaggaaagtggctgattttattaaaaagcagtacagttacaccttatccgtggatgaacagctctacctgctgatccatttaaagcggatattggatgaggagagggaactcccctgaccggatagagcggcatccggtacagggacaactgaatagatgatgattaagtttgttattattaagttaagcaagacttggttatgaaaggcgcagaccccgggaaggtgtgccttttgtaatcaggtctttatttatttcaatcatgaagaagaggtggatgatatggattatgaagtgatggcaaaaaaaatcttacagcgtgtgggcggcagtgaaaatgtagtcagcctgatccactgtatgacaaggctgcgttttaccctgaaggatgagtccgtggtggatgacgaggcggtaaaaaagacaaagggcgttatgggaatcatgaagaaggcaggccagtaccagatcattatcggcaatgacgtggctaatgtttacgcggaattgtgcaggctgggggatttctcagataaggttcctgagaaacagggcaaaccaaaagaaaagcagaacctgttctccatgctgatggataccatttccggaatcatgactccggtcatcccggccatcatcggcgcggccatgatcaaggtcctccttaccctgcttccgatgatcggaatcctggacaccgcgggtgagacatatcagctgctcagcgtaatcggcgacggcgcgttctttttcatgcctgtgctgattgcggtctcggcttccaggaagtttggcacaaacgtatattattcggccagtatcgcactcgtcatgctgcatcctaatttcatcagcatgatgggccaggcccacgacgcagggcagaccattcatttcctgagtgtaatgccggtcacctatgcatcctactcctactcggtcatccccatcatcctggccgtatggtcgctgaaatacgtggaaaagctggctgacaggattactccggtcatcaccaagaacttcttaagacccatgctggtcatgctgattgaggctcccattgccctgattgtccttgggccgctgggcgctattatgggaaatgtcctgtcagatgcggtctacttcatccacgacaagctgggattcattgcaatcgggctggtcgcgggaatctatccatttgttgtcatggcaggcatgcaccacgcgtttacgcccattaagctgggaatgatagccacaacgggatttgagaactttatctgcattggcgagctttgctccaatatggcccagggcgctgcttccgcggccgttgcactgaaaagtaagaacaaggattttaaacaggttgcaggttcctccgcattctccgcccttgtggcaggcataaccgagcctgcgctctacggtgtcaccctgaggctgaagaaacccatgctgggggcgtgtatcggcgcgctggccggaggactgttcggaggatttttccagatgaaatgcttcggcatcgcaacccctgccatcgtgaccatcatacagtacgtggaggacagccgtcccatgagcctggtcattgcggcgctgaccatccttcttaccgtggtagttgcattcatcgccacattaatcatcgggtttgaggatgtggtggatgaggatgaggcagatgaggatgtggcgtatgaggatgaggcagatgaggatgtggcgtatgaggacgagaaggtggaagcagaagtggaagagtcaggggaaatgaaggcgtcaggcaaggaaaccgccgtcatccaggcagcggaagaaccatcggaaacattcacaatcccaagtcctctggcaggaaaacagatacccctcagcgaagtaaaggacgccacctttgcaaatgaagtattagggaaaggaaccgccgtcatcccatcggcaggaaccgtggcggcgccgttcgacggaaccgtatccgtcatgtttgagacagggcacgcggtggggctggtaagcgatacgggtattgagctgatcatccacgtgggcattgacaccgtgaacctgaagggccggtacttccatccgctgaagcgcactggggacacggtcaaaaggggggaaatgcttctgacctttgacgtacaggaaatcctggacgcgggctatgacatcaccacgcctgtgattgtatccaacacggaccgatacagggaagtcgcttcatctggcaacggcacggttgccgcattggaccccatcctgtccgtcagatgaataccggtcccatccgctttttgttccattcactttctaaataagtgcaatacatgttaaacaaggaggaaaatcatgattcagataaaagcaaaccagttcccggaaggttttctctggggaagcgcatctgccgcgtatcaggtagagggcggatacctggatgacgggaagggactgaccaactgggatacctttgtgcgcataccgggaaaaaccttcaaggccaccaccggggacgtggcggtggaccattaccacagatacagggaggacattgccctcatggctgaaatggggcttaagacgtaccgtttttccgtggcctgggcaaggatttacccgtctggaagcggtgaggtcaacgagaaggggctggccttctatgagtcccttatcgatgaatgcctgaaacaccatatcgaacccatggtcaccatctaccactgggacctgccccaggccctggttgattcctacggcggctgggaaagcccgcggatcatcgacgattacgtggcctatgcccaaaccttattcagccgtttcgggaataaggttaagtactggattacattaaatgaacagaacatcttcacctcccttggatggcttacggcccagcatcccccggggcattttgacgaccggaagatgttctatcaggtaaaccatcacgcgttcatggcccacgccaaggcagtgcttaaataccgggaaatggggggcaaggggcacatcggcgccagctttgcctataccccgtcctacgccctggactgccgcccggaaaatgcaatggcaaaatgcaactacgatgacctgaagaattactggtggatggacgtgtatgcttacggccgctaccctaaggcagccatggcctatctgaaggagcagggaatagcgcccaggttgcagccgggggacgagtccgtcctaaggcgcgcggcagcggaaatcaccttcatgggggtgaactattaccagagctgtgtgtgtgaatacaacccgccggacggtgtgacgccgtacggaaccatgaatacaaccggggtaaaaggctccgcccaggaagtgggcatcccaggaatctacaaaaatcccgccaacccctatctgatgacaactgactgggactggagcattgacccggtgggacttcagttctgctgccgtgagattaccagccggtacggccttcccattgtaatatctgaaaacgggctgggggcatttgacaagaaggaagaggacgggagcatccatgatgactaccggattgagtatctgaaggaacatttaaaggccctggcccgggccatccaggaaggctgcgaggtgctggcttactgcacatggtcattcacggacctgctcagctggctgaacgggtaccagaagcggtatggattcatctatgtggaccgggaggaagaggaaggcgcgcccatgacccggtataagaaggacagctatgcatggtataaagaagtgattgggtccaacggcaggagcctgctggaaggataagcctgataggaaatatccgtgaaccaggcgcacaggattaaatgaaaaggtctgcggcttcgtgatggaaggaggaagccgcaggccttttttgcattccgatcatcatgaaaaacatcctgttccatgtcacatatgcaaaccctgtatcccacactactatcaaccccttcccgcctctgatataataatgtcaatatgaaagcaggtgaggccatgaagaagacaggagccgtgctggtggcggcgggactctcatccaggatgggggattttaagcctatgctgccctttggggattctaccattgcgctgcatattgtcatgatgttaaagcgcctggaggtatcgcccctggtggtggtgacgggataccgtgcagaggagctggaacgccatctttcccatgcaggcgttcggtttgtgaggaacgaacggtacagggaaacgcagatgtttgattcggtcaggctgggcttgaaagccattgccggacaatgtgagcggattatggtgatgcccatggatacaccggccatcatgccccggaccatccgccaggtgctgatgattgacgccgggatcgtgcgcaccgtgtgcaaaggcgagcctgggcatccaatcatgttccaaaatgagatagcagggcagctgtgcgcctatgagggcggacggggactcaggggggccattgaggaatccggcatcagtgtcacggacctggaagtggaggatgaggggatttaccgcgatgtggacacaaaggaggagtaccaggaactggttgaatggaattacaggaggggcatggggcatccgatcagccccctggtgcaggtcaggctcagggccggggatgtgttcttcgggccgggtacaggacagctcctccatatgattcgccagaccggctccatccaggaggcctgcctgcggattgggctttcctacagcaaggggaccaggatgataaaggaagtggagcgccagctgggaatcccggtggtcaaccgcaggaccgggggcatgggcggaggcggctccagcctgacagaggaaggcacaaggcttttagaaggctatgaacagatggttgcagaggtttcacggagcacggaagtgattttccggaaatatttcggaaaggggctttacggctaaaggaggatatatgaggacggtatatcttgtaaggcatggcatggtggattttccgggaggaaagaggcgctgcatcggccgcaccgaccttccgcttaatgaggtgggcaggaaacaggcagaggatctgggggagtatttccgcaccaggcccgtggaggcggtcttctgcagtcccctggcccgttcggtggaaaccgctaaaatccttgcgggaggcaggttccctgtgctggagacagagggactggccgagcttgatatgggggagtgggaaaatgtccctctctgcgaccttaagaaggaactggaatccgaacctcttttgggggagggccgggagcacggacttatgcggatggaccacaccatcaagcatatcctttcacatacgcagggggatgtggtggcagtggcccatgcagggattaactgctgttatctggccgggctaacgggccatccacttaacacctccagggcgctgacccagccctacggcgggatcagccggatcatagttgacgacaggggagctgtctttgccgctgagtctggcaggaaaccaaggatatccccctgtgacagggagtgcagggacatatgggaccactatgggaccccggagcgtgtaaggctccactgtatggccgtggcccagcaggcggaccgactggggagtgcgcttaaggaggccggatattatgtcaatatggagctgatacacagtgcggccctgctgcacgacgtggtcagggacaggaaggaccatgccgcggaaggggccagggtcctcacaagggagggctatcccctggtggctgagatcatacgctgccatcatgacctggagcatgaaatcatcaacgaaacctcggtggtatacctggcggataaatggatccaaggggaacaggaaatgtccctggatgaacggttttccaggagcagggccagatgcgggggaaatcctggcgccctggcggcccatgagcggcgctaccgccaggccaggaccatggaggaaaaggtaaggaactgcctgacaggattgaagacaggatgagttcctgtgtcaggcttccgtattctgacaatgaaattattgactgcaaaagtgtttacaaaaatcttgaaaagtgatatcctgtaaatggcgttattttaaaaaataaataacgggtggaggttaaggagaaatgaaactgattcagacagtggacgcagagggaaccgtgctgtgtcatgatattacgcagatcatcaagggggttaccaaggacgccgtgttccgcaagggacatgtggtgacaaaggaagacatccccgtgcttttaagcgttggcaaggaccagctctatgtatgggagaaggaagaggggatgctccatgagaatgacgcggcggagatactctgcgccatgtgcaggggcgcgcatatggaacgctcccaggcaaaggaagggaagattgaactgactgcttcctgcgacggccttttaaaggtggacaatgacgggcttaaggcggtcaatggattcgggcagatgatgattgccacccgccacggtaatttcgcggtaaagaagggggacaagctggcgggcaccaggatcatccctctggtgattgaggaagagaagatggctgctgcaaaggaagccgcctcccaggcaacgaagggaaggccgatcctggagctgaagccgttcgtacataaaaaagtgggtattgtcaccactggcaatgaggttttccacgggcgcatcaaggataccttcacgcctgtcatcgaagaaaaaatcagtgagtttgacacggaggtcattgaccatgtgacctgggatgacaatgatgccaaggtgacggccagcatccttgacatgattaagaagggagccgacgtggtaatctgtaccggaggcatgagcgttgacccggacgacaagacgcctcttgccatccgcaacacaggggccagggttgtgtcatacggggcgccggtgcttccgggggccatgttccttctggcctactatgacgtgacgcagggggatgaaaggcgcaccgttgccatcatggggcttccgggctgtgtgatgtatgcaaagcgcaccatattcgacctggtgcttccaagggtcatggcggatgatgaggtgacggcccaggaccttgcggcccttggacagggcggcctgtgcctgaactgtcctgtctgtaccttccccaactgcggatttggaaaaggactgtaggagggacggcaatatggaattcacacattttgatgaacagggcaatgccctgatggtggacgtgggtgacaaggcggacaccaaaagggaggcagtggcaaagggcagcattttcatgagcagcgaatgtcttaaaaaggtggcggaaggcaccatggccaagggcgatgtgctgggggttgccagggtggcgggaatcatgggggcaaaacgcacctccgacctgattccgctgtgccatatcctgaacctgacaaagctggccattgattttaccatcatagaagaaaatcatgagatacaggcggcctgcacggccaggaccaccggcaggaccggggtggagatggaggcgctgacaggcgtgacggttgccctcctgaccatctatgacatgtgcaaggcagtggacaagaccatggaacttggcaatatttatctggagcacaaatccggaggcaagagcggggagtttcataaccccaggaagtgatgttggagcattttactatgaaagattcatttggaagaaatattgactatatgaggatatccatcacggaccggtgcaacctgcggtgcaggtactgcatgccaaacggtgtggaaagcctggcacgttcggaaatcctgtccctggaggagattgaggccattgccatctgcgccgcttcccttggcatcagccggattaaggtgacgggcggggaacccctggtgcgcagggactgctgccagctggtgaagctgttaaaatccatacccggtattgagaaggtgaccatcaccaccaacggcgtgctgctggaccggtatctggagcctctcataaaggcggggattgatggcatcaacatcagcctggataccctggacccgtgtatgtatgagaggattacaggctttgacaggctggccgccgtgatgaagaccatagagcggtccgcggatctgcctgtaaggattaagattaatgctgtttccattgattttagttccatgggcggggaagactgccatggcccggagggaatctggtggaaggagctggtggaactgaccagccgttatccggtagacgtgcgttttattgaaatgatgcccatcggatacggcaggcagtttaagaccatcaaccacaaggacctgctggaagagatgcacagggaatatccggggcttacagaggatgatacggagcatggctatggacctgccgtgtactaccggataccgggcgcccttggaagcgttggacttatcagcgccatccacgggaagttctgtgatgcgtgcaaccgtgtccgcctgacctcacagggctttttaaagacctgcctgtgctatgaggacggtgtggacctgcgcgcggtcctgcgggagggcttaaggacgccggagggcgacggccattaccattggccattaagggaatgtccgggcgatgaaaagcttcaggcccgtcttgcggccgccatggaaaaggccataacagaaaagcctgcggcccactgctttgagcggccggggatgataacggaatcacacaatatgattgctatcggaggataatggaagggttatgggagatatgacagagaaaaaggaaagccctcagctggatcagccggggaaacgtgtggaaggagtgcttcctacaggcggggaaggagcacttcctacaagcggggaaggcgtgctgcccacgggcgtggtgaaggccatctgcatcagcgacatcaggggaattgaaaaaagggccattgaggaagggcatttcctggtggatttcggaatcgaaggggatgcccatggcggcaactggcaccgtcaggtgagccttctttcctatgataaggtaaaggcgtttaacgagaggggcgctgacgtgggcgatggggccttcggggagaacctggtggtggaaggcctggacttccgtgccctgccggtgggcacgaagctgtacgcgggaaccgtggagcttgtgatgacccagatcggcaaggaatgccacagccactgcgccatctacaaacgcatgggcgaatgcatcatgccaagggagggcgtgtttgccaaggtgctgaaggaaggcgtcatccgtccgggcgatgagatgcgtattgaactgccaaaggaagacaggccctttaccgcggctgtcattaccctcagcgacaaaggcgccagaggtgagcggaaggatgagagcggccccgctgccagggaaatgctggagcaggcgggttatgaggtggtggaaacccttctcataccggatgaacctgccttgttaaagacacagctcatgcgcctggcggacggacgccaggtggatctgatccttaccagcggcgggaccggattttccctgagggaccagacgccggaggcaaccctggcagtggcggaccggaatgcgcctgggattgcggaggcaatccgctataaatcccttcagatcacagacagggccatgctcagcaggggcgcgtccgtaatccgtaagaaaacattgatcgtaaaccttccgggcagccccaaggcggttaaggaaagccttggattcatcatggattccctggaacatgggattaagatactgcgcggaagcgcatccgagtgcgccagacactgaatggcgggatacggggcggacgattgccgcggcaggcagcaaccgtttaatcacagcatataacggatacaaccggcaggcccacctgtcatgggtgggcttttgcctggacttcgatatatccattcgagtataacggacggttcttgtccgtttacaatacatcatattataataaaaaggagcagaagattatgaaaaaacacattaccatgatgatggcggccgtgatggcagcaaccgtactggcaggatgcggggcatccaaggaagcggcaaccacagcagcaccttctgagactgcggcagaagccgggaccacggcagggactgaggcggggacagaaaccgaagcagataccaaggcggaggcagataccaaggcggaggcggcctccggccaggagaccgaaatcctggtggcggcagcggccagccttaagaatgcctatgaggaagaactgatccccatgttccaggccaagtatccgggcgttactgtgaaggggacctatgacagttcaggcaagctccagacacagattgaggaaggcctggaagccgatgtattcatgtcggcggcaaccaagcagatgacggcccttgacggggaagggatgattgcttctgacaccatcaccaacctgctggagaacaagatcgtgctgatcgtacccgcgggcagcggttctggccttgccaggtttgaggacattgaaaaggctgagagcattgcactgggagacccggccagtgtcccggcaggacagtatgcggaagaagcattgacgagccttgggatttgggataaaattcaggataaggtaagctttggcacaaacgtgacagaggtgcttaaccaggttgcggcatccagcgcggacgcaggcatcgtatatgcaaccgatgcagccagcatggcagaccaggttcaggtggttgcagaggctccggagggcagcctggccaagaaggtaatctatccggttgccgttgtgaagaacactgccaatgaagaggctgctaagaactttgtcgaattcctgaaaactgatgaagccatgaaggtgtttgagtcttacggattcacaaagggagaataatgaaggtagagaggggatatacatggattggtcacccatactgatttcgatgaagacagccagcctgtcgattttgattacatttttccttgggatttttgctgcctgggcagtggtaagccttaaaaatgaggtgtggaggctgttctgggacggggtgctgacgctgccgctggtgcttccgcctacggtggccggctttttccttctctatatatttggggtcaaacgcccggtagggcagttttttattgactatttcagcattaagattgcattttcctgggcggccaccgtcattgcggccatcgtcatgtcctttccgctgatgtacaggtcggccagaggcgcatttgaacaggtggaccagaacctggtggcggcggccaggaccctgggtatgagcgagtggagtattttctggaaggtattgattgccaacgcagtgccgggcgttgtcagcgggggcgtgctggcctttgcaagggggcttggggagtttggcgccacggccatgattgccggcaacatcgcgggcaagacaaggaccctgcccatggcggtctattccgaggtggctgccggaaacatggataaggcatacagctatgtggctatcattgtggtgattgcatttatttcggtttttcttatgaactgggcggcccttcggaccggaagcaggaggggttaggatatggttgtggattcaggacatgatctccgtttgggagtggatataaaaaagaagctgaaggaattcagcctggacattggatttgaggccggaaggggatgtcttgggatactgggaccatcgggctgcggcaaaagcatgacccttaaatccattgcaggcattgtaaggccggattcgggcaggatagcaatccagtatgcccagggggaagcggcagggggaagggtgctttacgattcatccttaaaggtcaatgaaaggccccaggtgcgcagggtaggctacctgttccagaattacgccctgtttcccaacatgacggtggaacagaacatattgaccggcttaaacagcgcgggcggaaggaaggccgtgtccaggaagcgccagcccctgacccagaaggagaaggacggaaaggtcagggaaatgctttcaaggttcaggctggaaggcctggaacagcgctatccggcacagctttccggggggcagcagcagagggtggccctggcccgcatccttgcatatgggccggaggtgctattgttagatgaaccattttcagccatggatacgtatctcagggaagggctgaggctggaactggccagcgtcctgaaggattacgacggggtcagcgtcatggtgacccatgacagggatgaggcgtaccagctttgtgacagccttctcctgctggacaggggaagtgtgctggctggcgggaagaccagggatatattccagtgtcccatcacctgccaggcagccaggctcacgggatgtaagaacatatccaggattggacgtctgggtccgcggcgcataaaggccctggactggggcgggttagagcttacaacggaccgggatgtggacggttccatcacagcggtgggtatcagggcacatgattttgaacccctgtccgatggggaggcagagcaatggaaaggcagggaaaacggaaacctgatccaggtgggttctcccaatatttccgagatgccctttgagtggtacattacattgtccaacggcctgtggtggaaaaaggaaaaggatatccacacccacaataccgccgggcttgtaccggggtggctgcgggtggagcctgcggcactgctgttactcacaggggagttaaatggataaaaggagaatgtggatatgaggacaggcgcagtggttgttgcggcagggcacaaaagttccgtaagcagtttttcacccatgcttcccataggggacagtacggtcatcagaaggatcatcatcacccttaagcggtccggcattgacccggtggtggtaatcacaggggaacagggggatgaggtggagaaacacattgcgggcctgcgcgtcatctgcctgcgcaatcagaattatgggcatacccagatgtataacagcatctgtctgggcctgaactatattgaggatttatgcgaccgggtattcatcctgcctgccaagttccccatgttccttccggagaccataaagcggatgatggataccgatgcccaggtggtctgccctgtatttgagggaagaagggggcatccggtgctggtttccagcgccgtcatcggtaaactgctgaattacaagggggaacaggggcttcggggcgccctcaggcaggcggatgtgtaccggtgcgcggccgaggttgaggtggaggaccagggaatcatcctggccgtggaaacggatgaggaccgcgcccagagtaacctggacaatgaacggctggacattttcccccaggtccagctgactctggagcgggatgacgggtttttcggtccctccgtggcccagttcctgtccttgattgaccatacgggttccatgcagacagcctgcagacagatgcacatgtcctataccaagggctggaagatactgaaggcagcggaaaaacagcttggataccccctgctgattacccagtcaggcggggcagagggaggttcgtccctgctgacccccaaggccagggatttcctggcccgtttcctccggatggagaaggaactgagggaggatgcgcagaagctatatgaaaaatatttttccatggaggatgagacaggtctatgaaagcattatttgaagagttatccaatgtattggcaaaaggggaggaggctgtgctggtcacgatcatagccagctccggctccacgcccaggggcgccggttcgcgcatgctggtgaggcaggacggcaccatcaaggggaccgtgggcggcggatcagtggaataccaggccatactcacggccatggaagccatgaaacataaatcttcctatacaaagggattcaccctgaaccggaaccaggtagctgatatcggcatggtctgcggcggcaacgtggtggtttactttcagtatatccgcccggatgacaaggcatttgcagaattctgcaccaaggtgcgggacgcccttggcagggatgaggacagctggctgctcctggacataacggacgaaacctgctggcagatggggctttacagcaaaagcacaggccttacaggcatggacaggccggagcaggcagagctggcgcttcaggaaccgctctttacaggcaggacccttcagcaggaaatcgggggacgcagatattacatcgaacccttggtccaggcagggacggtctatatcttcggcggcggacatgtggcccaggagctggtgcctgtcctgtcccatgtggggttccggtgcgtggtcatggacgaccgggaggaatttgccaaccgtgaagtatttccccaggcagcaggaaccattgtcgggaacctggaagagattggcagttacattgacgtcaggccctgcgactatgtgtgcgtcatgaccaggggccaccagtttgactactatgtgcagcgccaggccctgtccatgaagccgggctacatcggcatcatgggaagcaggaataaaatcagggtggtaacggacaaactgctggcagacggctttacaagggaagagatagaagcctgccacatgcccatcgggacggaaatccgggcggagacaccggcagagatagccatcagcattgcaggcgagttaatctgtgagcgggctgccaggatgggacgcaggaagtgaggataagacttcgttaaataaaatacaaaaatttttaggtaacctaaaataatttgtattaataaacaaaaacagaggatgtacggtctgaaagatcatctatattgcggattgtgcgccagcgggttccgggctataatcagagtatccaaatgataagcagaatactttgaaagaagggaacgcagatggcagtaatcgcaatcatacttgcatacggcatcctcagtgtggagctgtatggcgtcatcagggataacatccgtaaataaaatgggaagcaattgaccaaatgataggaaaaacagtcaggaacacagggcagggccgctggttcccggctgtttttgtgcgtttatggctttccttaaattgtaatttatgttaagataatctgtacgggaaactgaagggttggaatgggaaggattggaatggcgcacaggagggaggatgggcatggatgcatactataaggacggaggcggatggaaccggtcggacaggctttttgacgcgctggacctgaaagggcggatgggacagaaggcaaaaaaaggcagcgggccatatgtgatttccttaacaggcggaggcggaaaaacctccctgatccgccgtcttgcatgggaggggatggaacgggggcttaaagtccttgtgaccaccaccacccacatggccgtgccgctgcgcctgggcgttttttcgtgcagggaagaggatgtgaaggcaatgcttgaccgggaacacgccgtggtggccgggcagaccaatggggaagggaagatttcctacatgggggacgcggcctatcacaggttgtgcgccctggccgacctggtgctggtggaggcggacggggccaaacggctgcctctcaaggtgccgcggggcaatgagccggtcataccggacaatacggatttaatcctctgtgtcagcggacttacggccgcaggcagcctggccgctgaaaggtgcttccgcctggagacggcgcagcgtgtcatggagatccatgggcgcagggattatgatggtggggaagacggacagtggcggataaccctggaggacatgggctgcctgatgcggtatgggtatctggaaccgctccgggcgcagtatccgcaggcagagaccatacctgtattgaaccaggccgacacggtggaacttgcacgggctgcgtccgggcttttggatgaaatgaaggaggagggcgggattgcagcaggcaggctgctggaggaaacgtccgcaggattattttaacatgaatatatcatttatctatatggcgtccggatatggcagcaggttcggttccaacaaactgtgcgccatgctggacggcaggccgctgtaccgccatgggctggaatgcctgctggcggcggccggggaactgagggaaaaggatggatttgacgtgcgcctgatactggtcagccagtaccgggacatattggaggatgggaacggcctgggactggaaaccgtgtataacggttccagcagccaggggattacggcttccctgcgcctgggcactgaagccgcgggggaggatgcggacatccttctgttttttgtggcggaccagccctatatgagggggtccaccgtggcctcctttgtccgcgggtttgcaggatgcggatccgggatcggctgtgtggaaagcgggggccggagagggaatccggcggcattttcccgcagatacaaaaaggagctgctggcgcttatgggggaccggggcggcagcgtgatcatgaaggcgcacccggaggatgtatggaccatggaggtcccggaaggggaattaaaggacatcgatgtgcaggaagacctggaacggtaaccgtaccgcgggaccgtgcgcgggccgtgcctgtgggaaaggggggattgtatgagtgagatgaatgacttttcaaagggcagcgtcataaagaatatcctgaagctggccctgcccatgaccctggcccagctgattaatgtactgtacaatatcgtggaccggatatacattgggatgataccggaaaacgccaccctgtccctgaccggattggggctgtgccttcccatcatatccattgtcattgcctttgcgaacctgttcggcatgggaggcgccccgctgtgttccattgaacgggggcggggcaatacatctgaggcagagtccatcatgggcaatgccttcgtgatgatgatggcagtggggatcctcctgacggccacggggcttatattcaaacgccccatgctgtatctgttcggggccagcgacgcaaccataggctatgcggacgcctacataaccatctacctgatgggcaatatcttcgtgatgacaggtcttggcatgaacagcttcatcaactcccaggggttcgggaccgtgggcatgatgaccgtgctgctgggcgctgtgagcaacatcatactggaccccatatttatttttgtgttccacatgggcgtcaggggggctgccctggcaaccatcctgtcacagttcctgtctgctgcgtggatcatcgcgttcctcaccggaaaaaggacaatcctgcggctgcgcccgtccgccatgaagctggaaggcgcccgcatcctgcgcattgtggggctgggcatgtccggctttaccatgtccatcaccaacagctccgtgcagatcatgtacaatgtcatgctccagaagttcggcggtgacctgtatgttgggatcatgacggtcatcaactcggtgcgggaggtcatttccatgccagtcaatggccttaccaacagcgcccagccggtgatggggtttaattacggggcaagggaatacggcagggtcaggaagtccattgtgttcatgtccgtggtcagcattgcatacacggtggttgtatggctctttgtacatgaatgtccggaattcttcatccgcatctttaaccgggaaggggaactggtggaagcgggcgttcctgccatgcgggtgtatttctttggatttttcatgatgtccctccagtttgcgggccaggccgtgttcgtggggcttggaaaatcgaagaatgcggtgttcttttccattttccgcaaggtcatcattgtcattccgctgattctgatcctgccgtccgtattcaatctgggtacggcgggaatattaatggcagagccaatctccaactttatcggcggtacggcatgtttcgggaccatgatgctcacggtgtggccggagctaaaacgcggggcgaaggagaaaaccaaccaatgaagagaaatgtacttaggataacggcagcacttggggcggcggcctttctgttcaccaccggatttgccagggcggaagaccatgcatccggcaaggcgggatatttaaggtccgccacctattattccgatgactgggtcatcaatttctggaacagtgaaagcagccgtatggatgaggaactggcgcagattgccgaagacgggttcaacaacatcatccttgtggtgccttggagggagttccagccggacacatcgccctgcacctataacagctatgcatgggataagctggaccgggtcatggaagccgccgcggaccagggactgagcgtcatgctgcgcgtggggtatacatgggattattacggaagggataatgtgctctcccgctaccgggggcttatgtatgacggggaggtccgggacgcctggatggaatatgtgggccgtctttatgaacgggcctcgtcccatgggaatttctgcgggggcttcatcacatgggaggatttctggaactttacggacaccagcgccagcctgggaaataaagccagcggaaagaaaatggccaggcagtgcggctatacggagtatgccggggaacattacacccttgaggaactggaggacatatacgggcattccctggaaagctatgacgacctgtattttccggaaaaggattcctatgccaggaagatattctttgagttttatgatgatttcctcaatggactgctggctgaaagccaggaagcatttcccggcctttccatggaggtacggctggatgtggatcctgtggaacacggggacgggtcgctggagggattcatgcattcatctaccttcccatgcggggatgcagcctatacaagcaccatgtacagcgtgccaatgggctttttgaatgaacatgaaagggttacggcagaggaggtcctggagaaacttcccgtgttcatgaaccggcttcacgtgtacagcggcggaaagccggtgtacatcgaccagttccttttcacggacaacacagtgggatatgagcacaacgcccagctgatggacgaccagaaggcactgttcctggagaaggcggcccctgtcttaaaaagcatgaccatgggatacggcatatggacataccgggattacggcgacaataagctctacaatgcccagttcgggctgggacaggaaggctggaggttttctggcggcagcagcgtggtcacgcgggacagcaccaggcaggccatgatcccgggcggcgcaggcatttaccaggatatcggaaaccgtatgacaggcacaacaggaaaggatacacatgtaaggttcctggcggaaagcgagggcagcagccagctgtccgtcagcgcgttagggcgtaccaggaccttggaggtaaagggcgcgcgcacggttgagctggtttttgaaaattgcagcgcaaaggatttctccatcagtgtcagcggaagcaccgcctatgtggatgacgtccaggtatttacattcacgacccagggcgaactgtaccagatggacggttccgagggaagctgcattgaagcgctccgtctaatgaatcaaaatctataaaaagcgcatactatccttgtcatcggtagacgtttaaaccatgagaaggaggaaatgatcatgactaagctggaatgtagcgttaagaactgtgtgcacaatgcggataactgctgctgcaaggcggccattgccgtggacgggaacaaggcaaaggaagctgagcagacatgctgtgcaagctttgacgagaacaagggcggaaggttcaccaacctgtttaagactcctgagacaaggctcgatattgcctgcgacgccgtaaaatgcatttacaacgaggagcaccgctgtactgctgagcgcattgacatcagcggggacggggcctgtgaatgtacggagaccaggtgcaatacatttaaagcaaaataagattggctttggctgcagattgaggctgccataccggaaggatacggtatggcagcctcaattttctgtttttcacgaaattccggttgccaagggacaggattaagggccggaatgtgtgaactgcttgcaaatcagggcgttttatcatataataatctggataagggtccaagatttttgccttgggaaaagaggagatgaagcatatgagccgcagcacagccgggaggattgcaggtatatggtgcattgccatgctgttgggggcattgacaggctgcagcagtcaggcaacagaggaaaagaccgtgatcagggttctctatttaagcagctttaaggaggtggaggcactggttgagtccacctatgacgatattgacctgcaggtggagatatcgccttattccagcgaacagctaaggcgcctggaacggggcgtgggtccggacctggtggtcaccatgcagccggattccaatatggtggaaaaatatctgctggacatcagcgatacaaaggccagtacggcgtatgacggcactgtcatgaacgcctccaaactggatgggaagacatatctgatcccgctgcccggtgtgtacagcggatatgtggtcaatgaaaccatgtttgagcgggcaggcctgccatttcccacaagcaatgaaaacctggtggactccctttccaggctgaaggaaaaaggaatcggcatcggggaagatgatattaatttttcaatcatgagtgattataacacgtcggtgggcatgttttacgtgggttgcatggtgcctgatttcctggggaccgttgagggggttaagtggctggcggattttaaaaataaagaagcgttcttttccggggtctgggaacaatgcttttcgctgtcggattccctggtggaggccggtgtcatggatcctgtcgccattgcccggcagcgcaattcaatactatgcaaacagcgtttaagcaacggtaccctggcagcggcttttggggattcggcattgtactatgaatgtattgaagccaaccggaaagaggcagaggaggggatttcggaggcatatacctaccggatgcttccgcttttcagcgatgaagggaataagccctggtttctgttttcaccctcagccctcatgggtattaacaatgccgccagccaggaaaaacaggatgcctgcaagcgtatactggacctgctttcaacgcctgaggggcaggacgccctgattaaggatttgggggcaggcatgtcctgcctgcgggattacagccagcagaaggatctgatcccaaagggcgtggaaggatatgtggaatcaggatacatttacaatgtcctgttcccaagtaaaaccgtggaataccttggcggttacgtaaggaaaatcatgaatgggacatgctctgtggagcaggcattacaggcaatcgaccagttttactgcgaggggacggaccaatctgcctacgatttcactgtcatcggaactgtaagccatgacctgatggcgcaggattttaatgtgcggcgtggcgagaccgagattgggaatttcatagcggattgtgttgcccaggcatccggggcaccgatagcggtggtcaatggaggcgggatccgcgccagcttttatcagggtgtggtctatggcggggatatggcagcggtatgcccctttgacaaccaggtcattgttctggaaatggacggcaggaccgtgtgggatatgctggaaaacggtgtgtctgcctgcacggatgagtttcccggcggccgctttttacaggtctcaggtctcaggtatacctttgacagcagcagacctgccggaaccaggcttgtaagcgtgacattgccggatggtcaggatctggatttaagtgcggactaccaggtggcggtcacggactatatggccggtgcaaagagttacgctgaaggcaacggggacggatataccatgctcaactgctatgacgccggcctgccgaagggcaatgtggaactggtaaaggaaacagggctgtattaccgcgatgccatgtcggcttattttgaacagcacagggacatcgtggcagatccccggttggaaggaaggatctgcgatttagggcaggacggatagacagacaggcctcctgcgcggaaaggataggtgccattgatgactcacaacaagaggaatggggaataccggataccgctttttgtttccgcgctgcttctgatggtggctgtcctctgtgtgtttgcggttaatgtgtataaaaaagagtcagaacgcaccgtgacaaatatcagtaaggtttacttacaggaaatggccgcccagatcggcaggcatttcaaaaccaacctggacagccagttcttccagatccgcaccattgccagtgcagtatctaaggatgacttaaaggatgaggagagcctggaacgttttctgtcgcaggtgctgctggcggacaatgacttcacgcacgtggcagtcatcagtgataagggaatcgcctattctcccagcggcccggttccggccatgtcgaaaatctccggtcttgataagcttctggccggttcgcaggaattgatttccgtcaatgaatcaatctgggaaagcgatacaatcctgctcggcacacccataagccccttgccgtttaaagacggacagctggttgccttcattatcggaatccccactcctgacatgggggcaaagctgggactggacagtgagaaggaaacgaattcctctaccaatatcataaccaggaacggggacttcgtgattaagagcgccttttcagaggacgtgctatacggttccaacctgtttacaatctatggccagcaggctgtttttgatgagggctatgacctggagggaatacgcacggcggtcagggcaggggaaagcggcatgacgctgcttaccgtgggcaaccgccatgattatatttattatatgccgattcagggaacggactggtatatggttaccagcatggcatacgagatagtgaaccggcagattttatatctcagccagttcatggttactgtatgcgtgggtattttcctgatcatacttacgacggtccttgcattctttttattgctgaggcacagggaaaagctcagcagtgaacttcttcttgcggaaaaagagcgggcagaggcggccaacagggccaagagcgacttcctgtcccagatgtcccacgaaatcaggacttcgctcaacggaatcatgggcatggcggagcttggaaaaagccatacaggggagccggacaggatgcgcaattgcctggataagatcacgctttcatcaacacaccttctttccctgatcaacgacatactggacatgtccaaaatcgaaagcgggaaaattgaacttcatatggaacggtttgatctgggacagcttctgcgtgccctgacaaccgtgttccatgtgcaggcggtcagccgtcagattgattaccatattttcctttacggggagatagaggaatatctgacaggggattcgctccgtctgaaccagatcctgaccaacctgctgtccaatgcattaaagttcacgcctgcacaggggcaggtcagcctgaacgtatcggaactgcggcgtgatgaaagcgggatatggctccgttttgaagtcagggacaccggacgggggattgccccggagaatattgaccgggtgtttgaggttttcacacaggaaaacagcggaattgcccgccagtacggcgggaccgggctgggcttgcccattacgaagaactttgtggaaatgatgggcggctccataaccgtttccagcaaggtaggcgccggcagcatattcacggttgatataccctttgcctatgcaggggatgagggggaacgggatgcggattactgcggcaacggccagccggtcctggtcatgaatcaggttacggaattggaaacacatctggctgccctgctgacaaaggaaaggttcgtggctgacaaggcgtccactgaggatactgccctgcgcatgatgcgggcggccgtggaaaacgggaatccatatgaattgtgctttataaagtgggatttttcggaagatatgaagcgttttactgaaactctccgaaaaacagggaaaaatagcaatcttaaaatcatcctgacaggacaggaccaggatgaactggacgatgccgccgcattatgtgatgccgatgcaaccctgtgccggcctgtattccattctgaccttgccgggcttatgacggagttcagggcccgggcgcagggaaagggaatcccggaacaatccggcggattgaacggggaacaggttctggtggtggaggataatgaaatcaacctgtatattgcagtggcccttctggaggatgcaggggccattgtcaccacggccagtaacgggcaggaggcggtaaaacggttccgcgaagccccggaaggtttctataaactcatactgatggatgtgcagatgccggttatggacggttacagcgcgacgcgggccatccgcgcgcttccccgctccgatgcaaaacgcgccatcatcatcgcgatgacggccaattccttccatgaggatatccaaaaatgcctggacagcggcatggatgcccatattgcaaagccctttgtcatgaatgatatttacagtacatatgcagaggtcttggatgaaaaggacatgattgatgaaagggaacaatgatttgaaatacgagatgatgatgtatgagagggtataccggattttaaaaaataaaatagaaagcggcctgcttccggccgggtccagccttccctcccgcgcggacctgcgcctggaattcggggcttcggaaaagacaatccgccgtgcccttaacatgttaaaggaaaagggattcatcgaaaccgcacagaggaaacgccctgtggtggccggtcatataagcacgggacatctcgccacaacccttgccttaaaaagaattgacactgacatcaccaatgatgtgctgaaaacaggcgtgctgctgtgttatccggtgattaaaaagggaatcgccctttgtggacaggctgacctggacattccgcgcaggatcctggaaaacatggacccccaggatccgtcagggttttggaaactgtccaaacagttcttgcggttctttgttgcccgcaatgggaatgccctggttttgcaggcagtggacagcctgggcctgtccgacttgaaacccctgcaggacagcctggaagccaggattagatattacggacagctgcgggagctgatgcatgccattgaaaccggaggcgcaccggaaagcgtccgttttgatgatatgtccgggatgtatgggctgacgggcaaaagccggccggcctttaaggttgcctccgactccgcggtccttcttggcaggaagcagcttgaaaagatgctgcagggagccgaggtacggtattctgcggtgtatatggatcttatggggctgattgcggcgggacgctaccaacgcggggaccagcttccttcccacaaagaacttcaggaaatttacggcgtcagtgttgacacgacccttaaggcggtacagatcctgcaggaatggggtgtcgtgaagaccgtccggggcaacggtatatttgtggagatggaccggaacgatatccgggacgtccatatacctccacgcctgattgcttaccatgtcaggcgctatctggataccctggaacttctggccctgacaatcgaaggcgccgctgcctgcgcgaaagcccatatcaccaaggaaggactgcaggcagtgaaggcggagatagaccgccagtggaatgaggattatctgtatgagcgcacgccggccatccttctggatttcattgccagccacataggcatagatgcgttcggcgccatttacatgttcctgcaaagggattttaagattggccgcagcattccgggcctgctggacacggaaaaaataaccgtgaaccgccaggtccatgaacagtgcgtggaagccgttgactcgctttccatggggaatgaagggggattccctgaaaaatgcgcccggctatttgatgccatacgtcacctggtaattgggaaatgccaaagcctgggatactatgaggctgcaatgggcgtctatgacggaacagcgctatggaagtaacctgtaaaaataacctgtaaaaaaacattgacaaacggtccggaatgtagtaaagtaataaaagttgtgagaacgactgacaggaaagcaggtatccgcctcaccctggcacgagtaagtgacccgggttcatagatgaagtgatgtgctgtagcatttccatgggagatgggtcagcagatgattttatgtgtgttaagagtggatggtctgactgtccgctttattttttgccctggagacaaaaacggggcgtgctgattcctgaacatattgacttatttattatggaggtgtacgaccattagcgaattaatgattaacgaacaaatcagagacaaggaagtaagactgattggcgaagacggagagcagttaggcatagtccaatttaaggacgcacttaagatggctcaggatgctgagcttgacctggtaaagattgcgcctaccgcgaagccgccggtatgtaagattatcgactacggtaagtaccgttatgagctggcacgcaaagagaaggaagccaggaagaaacagaaggtaatcgagataaaggaagttcgtttgtcccccaatattgacaccaacgacctgaatacaaaggtgggggctgccaggaagtttttagagaagggtgataaggtgaaagtcacactccgtttccgcggacgtgagatggcccacatgtacaaatccaaatacatcctggatgatttcgctgagagtcttaaggacattgcagtaattgataagccctctaaggtagaaggaagaagcatggtaatgtttttaactgcaaaacgttaaaatagaaagttttaaggaggaaattaatatgccaaagttaaaaaccagcagagcagcagcaaagcgctttaaaaagacaggaaccggtaagttagtccgcaataaagcttacaagtctcacatcttaactaagaagtccactaagagaaagagaaatcttagaaaagatatcgttaccgatgctaccaactcaaaggtaatgaagaagattttaccatatctgtaagttgaattgtagaaggaggaaataccgatggcaagagttaaaggcggtttaaatgcaaagaagaaacacaatagagtcttaaagatggcaaagggctacagaggcgcccgttccaaacagtatagagtagcaaaacagtccgtaatgcgcgcactgaccagctcctacgcaggcaggaaagagagaaagagacagttcagacagctgtggattgcacgtatcaacgcagcagcacgtatcaatggcctgtcctacagcaagttcatgtatggcttaaagttagctgaggtggatttaaaccgtaagatcctgtccgatatggctatcaatgacgctgagggatttgcaaagttagctgagctggctaaatccaagattgcttaattatctgcataattgaatctgtaatcataaaaggtgctgtaaaccgatggcgggtaaccgcgtgaagggctgcagcacctttgtttgttacctggcctccgataaggtggacaggacggcctttatatccggttcattggcctggtctgagacagcggcaaggacggcgtagtagctgcccatgctccgtacatataggtaaccggacagggaaccggactgggcaggagggaagtaaaagcgcaggaactcaaggttccctgcctgcactgcttcaatcctgccgccttcctccagcgtgtgggaaccgccctggaacatgttcaggaaagccatggcctggtccgcggcatccccttctttgttgggggcgtagagaagcatcacggcgcagttttcatttttcatggacagcatgtccaggaaggcgtccgggcctgcaagccgtgacagggaagaggaatcgtaattaatgaatccctggggaacggtaaggcggatattggaccagtcattgacaaaggtggaacctgtccagcggcccatcacaggtgcctccccggcctggacagtcattgcgccgctgcggtcaaaggtgtaggggacattgtcaatggtcatggtggtgtccgataccatggccccgtccgggccgagatagtaccagattccctccttctgctgccatcctgtgagcatgtagccgtcccggtcaaacagataccatgtcccgtctatctgttcccatgtgtctgcgggataggacctgtcctccctttcataccagtatccggtgctgttaagctgccatcctgcggcaagggaagggacggcccacatgacggagagggccagggcgcctgccagggcagtgatggatctgcatatcctcatattactcctccttcttattttatgatatgaacattatatgaaggggaatggggaaatacaacctgtacttatcatatgcggcatatcatatgtatgggagggaataccaagattacggatgggaggaaaagaacatgaagaaagctttattttatggaatactggcatcgtttttctttgcctttacatttatactgaaccggagcatgaacctggccggaggatactggctgtggtcggcctgcctgcggtacctgttcacccttcccatgatggcgcttatgcttgcgcgggagaagggggctgtgacagaggtactgaaggcaatcagacacaggcctggaagctggtttttgtggagcacggtggggttcgggctgttctatgccccgctcacctttggctccgtgttcggggagtcctggctggcggcggccacctggcagctgaccattgtggcgggggtggtcctgacacccctttttggaaaaaggatcccggttaagaacctggcctggtccatgttcatcctggccggtatattctttctccaggtgccccatatggaacagacggacgggaggacggtgttccttaccctggcccccatactggtggctgcattttcctatcccctggggaaccggaagatgatggcgctgtgcccgccgtccatgacgaccattgggcgggtggccggcatgacgttctgcagcatgcccttctggcttctgctgtccatattggcggcggtgcgcacggggatgccgggacggggacaggtgcttcagtccgtctgtgtggcccttttctccggcgtcatagccacggtcctgttctttaaggcaaccgatatggtgaagcacaatccaaggcatctggccgtgattgaggccacccagtgcggggaagtggtatttaccctgcttggaggcattttcctgctgcatgacggggtaccggatgcagtggggctggccgggattgccgtgatcgtggctggcatgatcggcaacagtttggcggccggcggggaggattaggttaggattccgttaagaaatgcgtaataattattattttgcattaggccctaaactatgatacactgatttatgaagttacagaattaacaataatcaggagtggtttaagacaatgctggaattatcgggaatatgcaaatcctatcgcagacagaacatccttgacggggtggaactcacggtcagaccgggggagtgcgtggggattgtgggatataacggctgcgggaaaaccactcttttgtctattattgcaggcgcattaaaggctgacaaaggaagcatcctgtttaacgggaagcaggcggtgggccatccccgcgtgtttgcagaggaagcagcctatgtcccccaggagaatcccctgatggaggaactgtcggtcagggacaacctgatgttgtggtaccggggcagcaggacaaggatggaagaagacctgcgaagcggcgcagccgccatgctgggagtggataagatgttaaaccgcacggccggcaagctttccggaggtatgaagaagcgggtcagcattgcatgcgccctgtccaaccatgcgcctgtgctgatcatggacgagccgggggcggccctggacctggagtgcaaggaactgatacggaattacctgcgggagtatatggcaggaggcggcgccgtggtgctgacatcccatgaactggctgaactggccatgtgcacggatatgtatgtgctgaagcaatgccgtttgacaaagatcgttaatggttcgtcagcagaagagctgatccgccagtttcgatagaaatacgaaggcacatgccacccggcatggacctgatgtaagggaggaaaataagaatgaaatgcaaaaaatgtggtgctgagtacggggaagacgtaaagttctgtacccagtgcggcgctcctatgggagatgaaggccaggattcccaggcagggacagagcctgccatggatgcccaggcagatggggaattagaagccgggacaatcagcgcagaggcgccggcgccggaagaaggacagccggaggcggcagagacggttactgagcctgctgaagaggccgggacagagccatcaccggcagagcctgctgtcaaggcagaagagccaaaggcagacggtcccatgtcggttccggtaccggcgtcaggcgaaccggagccaaacaagaagttcctgaagatcctgttcgcggtcatcgcggtattggcagtgattgccgtcgcggcagtggcatacgtgaagatgaatgccaaagaccccaagcaggtggtaatcgatgcatttgagaaggtctataccgaaggccaggtgttcccgtcagaggaactgttcggctttaaggatttctcagaggcagcgcttaaagctgacatggaaagcggtcttacccttaagatggacagctgctccgacccggatgtaaaccagtttgcgggaagcgggctgcgtctcgagggcaggagtgacaagacaaatggcaaatcctcctttaatatgggtgtgatttataatgggatggacctggctaacctggatgcctactacggtgaggacaccctgatgatggcggttcctgaactgagcggcagggtgtttaccctggacctgggagaaggccttggggagcgcattaaaaattcacctacagtaggtccgctgctggcagagaacggcgtggatgtggacggactggccggatactttacagacctgatcgacgaggccgagaaggctgaggaagagggcaaggccccatttgatatcgaagccctgcttacccgctacagggaaggcagcaatgcacaggagaatttcaaggcggccatgaccgttgagaaggctgacaagggcacctacaccatgaacggcgcgcaggtcagctgccagggatacgatgtgacgatcagcaaggattccatgattgaattcctgcgcacctcttctgatttcttccttcaggatgagaccttgaaggcggattacctgaaacagctggaagccacggtcaggatgagcgagctgatgggcagcgccatgaccggcatgggttccatgtctgccgagcagatgcaggaacaggcctacgatgaagtaaaagatgctgtggatgagatgattacatatctggacaagtccctgaccgatatccagatgacggtttatgtggataaggacggtaaccttgcggcgttagagggaagcacaaacctgtacgtggatgattcgcttgcggaagaagagggctatgttgcagtgacatttaaccttacgctggaaggcggcgcatacctgacacagaacgtaaagggcaatataacactggaagacgcagacgacacggttaaggtggacctgtcaaagcagggaacctatgacggaaagatgctgacctgcgacctgtcggtggatgtgactgcaccggatgcatctgtttataacttcatgtacacaggcacctatgattccaatgacggcagctaccatgccgctgtggagcttggaggcgagggttcccagctctttaagatgtctgcaaccggtattgtggaccagatggaaaagggcaaggcttaccatatggatatcgatgccctggagattgccgccatggataattccatgaacatggtactcagcggcgagctttacagccgtccgttaagcgctgaggtaacacctcttgatggcgagccgatggacgtactgtcagcaaccgaagaggactggaacaatgtccttatggaaatggtattcggcatcatcggactttcaggacagcttgaagttcccatgggctgatgccaaaaacggtaaaacaggaataaaacagggcctttggttcatttccgtccggagatgggccggggccggatcataacaaaaaggaatggggaaatatgtctgcacgtctggtttatctcaagctggagttaaaacgagcatgtaaaaagcttccccacatcattgcaggggcaatcgtgctgttactattagcggttacggttgcctttttggcaagcaggatgttgtatggggagcaggcagcagggaggattaccgtgggggtagtgcttcctgagggtgatgccgtggcacagaaggcggtggccatggtcagctccctggaaagcgtaaaaagtatctgtgattttgaatatatggacaaggaagagggcatccggaaactgaaggaagggaagctttatgcggtgatggaagtgcctgaaggatttgtgcaggatatcatgaacgggaccaacacgcctgtgcggattgtactgcctgggggcgcgggtctggagggcaggatattcaaggaactgacggacgcaggggccaagaccctgggggccagccaggcgggaatctacgccggggatgaactctgcgtcctggaaggcatgacggactccatccctgtcctggaggcggacctgaaccggattttcatgggatacagcctgccaaggatggactatttcaggaatatgaaggtgactgccacaggggatgtggataccctgcatttttatggtatcagcgcggcggtgctgttcctgcttctgtgtgccattcccgtatcggcgtacctgtcaccggcccgtcccgtgatgaaacagaagcttaagatacttggaatcgggaacgtgacggtcctgggggtcaggatactgggcctgggactgcttctggcagcggttgcacttccggcggcggcagcggccggcggcgcgggattcattccatggggggtgaagaccgtgctgcctgtgaccgccgtatgcctgtcggctgcttccatgatcgtgttcctgtatcaggctgcgggaagcctgatgggaggcgtcatgctgctgtttttgaccgtgacggccatgcatttcatggcaggcggattccttccgctggtgttccttccggcatccatccgggcggcggcgccgttcctgccgtcctatatattcatggagggcatgaagatggcggtgacgtctgtcatggaccctgtcatatttgtcaggctggcggctgtcatggcggtatgcttcctgctcagcctgtgggtggaggtgggaagacgatgaaaaaggtcatgatctggttcctcctgtcctgcaagcggtatgtgcgaaagccatccttcctggtcatcctccttctgcttccccttggaatcctggcggcagacaggagccagggccataaggagcaggagattaagattgctgtcagcgtccagggaggcgatgggaatgaactgggccggcggctggcagaaagccttgtgaaccgcgggcggggcgttgatgcgggtatgttcctcttttacgaatgcagggatgaggaacaggtaaaggatgaggtggcttccagacgggcggaatgcggctatgtgataacggaaggactccgggaaaaactggattccggcaaatacagacgcagcatccttgtttattccgctccctccaccgtggcggcatccctatccacggaaaccgtgtttgcggcgctgatggagatttacgaccgggatttactgacagcctatgtggcggaggaaagcctgtttgattccctgggagcgccgggaagcagggacagggaacaatctgccctggaggccggcgcactgtatgacaaatggcttgacaatggaagcaccttccggtttgaatacagctttcagggtcaggaaggggccgcagacctgcccggtacgcagactcaggagaccgtgttcccggtaaggggcatggttgctgtttacgtgttcgtgacaggcctttacggggccgtggtgctgtgcggggatgaggagagagggctgttcctgcccctttcctatggttacaggacgccctgccgccttgcatccatggcggctcccgtggccatggcagccgtgtccggcctgctggctttgtgggccagcagaagccttgttggccctgtaaaggaaatcgtggcaatggcggtctactgtatggctgtgacggctgtttcctggcttttaaaggttatctgccgcaggccccaggtcctgtgctgtatcattcctttttttgtcatcggaagccttctgttctgcccggtgttcattgacgcgggacggtatctggatgtccttgaccaggttgggaaaatattcccgccctggtattacctcaggtggttcggataataaacattgtattctgatgtaaaggctggtataataagggttacggtaactataaaggagatgattctgtccggcgcacttgatgctgcacaatcagcagcataagtggaacgtggaaaccaagatgatcagaactgcataagggacaaggcctgtatctacaggttctgttgtcgtgccagcatgattatcaggaattccgcgttaatacgatttaacattaactgtgggattcttccacagtttttttaatccccatagttaccgtaagctgccgtaatccaaattgaaaggacaggatatcatgaagaatttattgaaaatgttaaaagaaaaaccagctttatatgaggcctcgcctgtgaatatgtgggatgacccacatatatcaaagcagatgctggccgcgcatctggatgaaggattcgattccgcaacaaggaagatggattttgtaagggaatccgcagggtggattgcatccctgcttccgcctgaacgttacaggaggcttctggacctgggctgcggtccgggtatttatgctgaactgttctgccataaggggtatgaggtgaccggcgtggacatatcgaggcgctccatcgggttcgcccgtgagtcggccggacagaagggtctggcaatccaatattgccggaaggactatacggcgtccggccttgggggctgttatgacctgattaccctgatatactgtgattttggcgtgctggcccgggatacgcggatgacgctgctggcccgcatttacgattccctggccccggaaggcgcattgctgttcgatgtgttcaaaccggtaagatacagcgggatggaagaaaccagggactggaaggtggaggaaaatggtttctggcatgagaaacaatacctgctgctccattcgttctggcggtatgatgaggacaacacattcctgaaccagtatgtggttgggatggaagatggaaccgcctattataatatctgggagcatacctttacatttgaagagctggaacgggatttgaggaaggccggatttggccggatacagttctacggcaatgttgccggtaaaaaatgtgaagatgcagatgatacgatctgtgtcctggctatgaagtgacagtaaacaaaaaacccggattccatgattgaaatccgggtttttcctgcaagtgcagaagaagggagtcgaaccctcaaggtattactaccacacggacctgaaccgtgcgcgtctgccaattccgccacttctgcgtctgatgccaggctgttgtctcaggcaacgaaagttattataagataggttggcctttttgtcaacactattttcaaaaaaatttcctgtgattaccaaatttattgcgcataaaacttacataaaaaaaattagaaaaaatttcaaaaaatagttgccaatttaaaaactctgtgatatactatcattcgtgttgcgggagtgctggaattggcagacaggctagactaaggatctagtggttgtatgatcgtgtgggttcaagtcccatctcccgcactatttgtaagaggaatctttgctggattgcaaaggttcctttttttctgcgcatgtggttccggacacaccttgggacaggcccgggattttacaaaatacaggtgtaatttgggatgggatatgctaaaatgaaaacatgtggataagaacatatgacctgagagtgacagatcagacgatgtgtatataaaaccggcggcagtgtgggaatcgctcatgtccggttccggtagaaggaggcattatggatttaaatacaatacttacacttcaggaggctggggtggatacagagggcgcagtgaggcggttcagcggcaattcagggctttatgagcggttccttaataagtttttatccgacccaacctttgggatggtgtcggatgcatttgcgacaggggatgagcagaaggccctgacagccacccatacctttaaggggctgacggccaacctggggcttacaaagctttatgatatttcatctgagatggtgaacctgataaggggcggtgattatggggcggcggccgggactttccctgacctgaaaaccgcatatgatgaaatctgcgggattctggaaaaaggctttctttaaaaatactccatggaacggaagtgcggattcacggggatccgtagagaggaagaattgacatgcgtcagcgagatacgattctgatagtagatgatatggaggttaaccgggtcatactgagcggtttgttccaggaagaatatcatctgttggaagctgagaacggagaacaggcccttctgcttctgaagcagtatcacagcaatatagcaatcatgctgctggatgtggtcatgcctgttatggatggatatcaggtcatgaaggagatggggggcagcggacttctgggtgaggtgccggtggtggtcattacagcagataactccctggaaggggaactgcgctcctttgacctgggcgcctcggacatcattgtaaagccctttgagccacatgtagtgaagcggcgtgtacataatatcattgagctttacctgcataagcataacctggaggacatggtggaccagcaggcccataagctgaaggaatccaatgacgtgctggtggacgccctgtcctctgtcattgagtacaggagcctggaatcgggccagcacataaagcggatccgccttcttaccaaggtccttcttcaggaactggccaaaaactgtccggaatatggactggaccagcataagattgaggtgattgcatctgcctcagccctccatgacattggcaagattgccattgaggaccgcatcctcaacaagcccgggcgcctgaccccggaggagttcaatgtgatgaagacccataccaccaagggatgccagatactggaaagcctggggcggatgagtgacaaggaatatctgcagtatgcctataatatctgccgctatcaccatgaacggtgggatggaaagggatatccggaaggactctgcggggattcaatcccggtctgcgcccaggccgtgtcggtggtggatgcatttgacgccctgacttcggaccgggtatataagaaggcaatcccttaccagcaggccgccaatatgatcctcaatggggaatgcggcacatactcccccaggctgatggaatgctttaagccggtgctgccggtgctgtccgccctgtgccagaagtatgccgacggcaatgtgccctttggggacccgcttaacatgcaggaccaggagcaggctgcggttgagaacggcatcagcgcgcttcagttggagcagctgaaatacctggccatgctgcgttatgagaatacgatggtggccgaggtggatttttcttcgggaagctatcacctggtatatgcgcccaatctccggattaagcgtgcctttcagggagagcgcctggaggatgcggcagaacggtatatttccgagatggtcaaaccggaagaccgggagtacatgcagattgcatggaaggaggaaatgcccgggttctttgcgcagggactgttaaagcagtcctggaagcaccgtgtcagggaagggctgggctggtgctggtatgagctgaccatcctcaggattgatacggagcatccgcgccagagaaaggccctgcttttgtggaaagccctggaggaggatttggctggggaagggaaacaggctgttcctgaggataaagatgacagccggatcctccatcagatattaaaggggatttcccgttaccgcaacgaccagtggtttaccatccttgatattgacgatggattcatgggatatggaagggatgccatccgcagtaagtttaatgaccgctatctggaaatcatccatccggaggacaggggacgtgttaagaaggaactgctggaccagctgaacaggggaagtgagtttgagctggagcacagggtgattgatgcggatggatgcatcaactgggtgctgaccaagggctgcctgatgacggaccggtcgggccaggagtatctttacagcgtggtcattgatatcaaccagacaaaacatgcccaggaggaactgcgccttggcctggagcggtataaaatcgtcatggaacagaccaacgatatcttttttgagtgggatgtggaaacagatacggttgcctattcctctaactggaagacaaagttcggatacgatcccatctcaaccagggcatcggagcgtatacccaagatatcccatctccatccggaggatatggccccctttggggcattcattaaggaaatgcgttccggcagacgttacggggagctggagttcaaggtatcggattccaggggccgctaccagtggtgcaagctcagggcaaccatgcagtttgatgaccagggaaggccgtgcaaggcaatcgggattgtgatagatatcaatgacgagaaaatggcggcccaggaactgaaggccagggctgaacgggatacccttaccaagctgtacaataaggcctctgcccgccaaaggattgaatacatgctggtgaaccgggaagagggggaagggcttgccctgttcatcattgacattgataactttaagctggtcaatgatatgtacggtcatatgttcggcgatgccgtgcttaccaagattgcggcccagctctcccgtctgttcagaagcagcgatattgtatcgcgtatcggcggggatgagttcatggccctgctccagggcgtgctgaacggggatcaggtgcgggtggttgcggaccgtatcctggaatgctttgaccgggtcctggaggaactgcccaaggaatgcagtattacatgcagcacgggaattgcagtgtgcccggaagatggggaggatttccagaccctgttccagaaagcggatgtggccctgtaccatgcaaaggcctgcggcaaaaaacaataccagatttatgaacagtccatggagaataaggcatatggccagaatgccccaagacagacagctgccaacacgaccatcgaatcggaggaaggcagtgaagtggtgttgaacgacctccttccacgggcctttaatatcttcagcaaggcggtgcagctggaccgggcggttgagaatgtgctggagctgctgggggaacgcctccaggtaagccgtgcctatatatttgagaattcagaagacggccggtcctacagcaatacatttgaatggtgcagggagggaatcaagtcccagaaggatatgctccaggacatgccatacgccggtctgagcgtggattataaaagctttttcaacgagaggggcatcctctactgtgatgacataaacaagctcccgaaggatataagggagaatctggccagccagggaatccagtccatgctccagtgcgcaatcaaggataatggtgaatttaagggctgggtgggttttgacgactgtacgtccaaatgcatgtggaccatcagccagatagaggtcctgtcatttatctccgaactgctgtccctgttccttctaaagcgcagggcccaggacaatgccatggagctggcggaggatctgcgcacggtgctggaccaccagaattcatggatatatgtggtggatgcagagacaagggagcttctctatatcaatgagaagacccacgggattgccccggattccagggtggggatgcgctgccatgaagcgtttttctgcagaaatgagccttgtatcaaatgtccgatgaatgatattagacagaaaatcaactgtacgctggaggtatataacccaatccttaaggtatggtcgctggcggatgcctccctgatccgctggggaaagcgggacgcctgccttcttgcatgccatgatatcaccaagtataaggaaggccgggaggaaataacaaagaattaagattttcaggggcacatatggaaggaacggaatatcctgattataaagaaacaggtgctgcctggtatcaatagccggataccctcagtgtaccggggccaaccccctgtacactgggggtattgtatccctgatccatacccggcggcgccaagaggagttaccatatgaaacgttgtgtaccactagagccggcagcggaagctgtctgcgaggccaattccaaaccgccccttatatttgaacttccccctgcccagggaaggatggcgttagaaaaggcccaggacagtccggtgtacaaatatcctgcccaggtaagccgggtcagtgtcaataccggaagatgggggacgataccggtttacctggtgaatccgggcaatacgccggcgttgtccaatgtgattttcttcatccacggcgccggctgggtgttcggcagctatcatacccatgagaagctggtgcgggagctggcgtccaggaccggttccctgcttatcttcccggaatacagccgttccccggaggcacgttaccctgtggccattgagcagtgctatagcgtactgtgcatggtgccggaattggtccggtccatgggctttaccgccaatccgggaacgctgaccgtggccggggacagcgtgggaggcaatatggccacggtgatgacaatcatggcaaagtacaggaaagggcctgccatccataagcagctgctgtattatcctgtggccaatgcctgttttgacacatgtacctaccgtgaattcgcggaaggatattatctgtaccgggccgggatggagtggttctggaaccagtataccatgtgccagaaggacaggaaccagataacagcatccccgctcagggctgtaagggaccagttaaaggggctgcctcctgccatgatcctcaatggggaagccgatgtgctccgggatgaaggcgaggcctatgccaggcgcctgagggaagccggggtggatgtgaccgccatccgcttccaggccatcatccatgattttgtcatgctcaattccctggaccagaccagggcgtgcagggctgcgatggatgtttccacggagtggataaaccggaaaaacagataacagcggccccggtttttcaggtaaaaaggaaacatcttgaaattaacctgcttatattctatactaagtaacaacaaacagtcggaccgtacataccctggcagcaggaaaatgggatgtacgggactgaattgcataagaggggcgggcaggttatgataaaggtatttcttgtggaagatgaggttgtcatgcgcaatggcatcaagaacaacattccgtgggaaaaggagggcctcatgttcgcaggtgaggcaagcgacggggaactggcgtatcccatgataaagaaagcgcagccggacatcctgattacggatatccgcatgccgttcatggacggactggagctttcagagctggtgaaaaaggaattccccaaaatcaagatcatcatcctcagcggttataatgagtttgactatgcaaaacaggccatccacatcggggtcacggattacctcttaaagcccattaccgcgtccaaactgctggaggcagtgaaaaaggtggcggatgtgattgagaaagagagggaagaggaggggatgctggagcgttaccgcctggagatggcggagaacacggtgctggagcgccagcgcctgttcaaggatctggtgaccagccgcatcaactttaaggaggcctttgaacggggggaggagctgggcctggagctgtcggcctccttttaccagctcatgctttttaagctggttccttccggcccttccagcatatggtccgacatggtggtttcctgccaggaggccattgaggaacatatggagggaaggtcccacatccttgtatttgaccggggggacgagggctgggcctttatcctgaccggggagtccgagcaggaggtggggcgcaggatgaaggaatgcgcggtccgtctgggggaactggtgcatacatacagggacatacagtattttggcagtatcgggagctgtgtcaaccggctgggggacctccagcagtcctaccagcaggccagccaggcatttgcctgccgctttttctcggaaatgaaccaggtggtggattacaatcagatggagcagatgttttccgccacaggggaacccattgacatccattcggtggacggctccaaagtaaaccggaagaccctggagaatttcctgaagcaggggaccgcagaggaggccaggggctttgtggaggaatatttccagaatgtgggtgagaagaattaccagtccttcatgttccgccagtatatcatcatggactgctatctgtgtgtgcgcaccttcctggaggaactgggaatggatatgttaaagcttcccgagggagtggctgacatggatatggtgctgaaggaaagccactccattacggccttaaaggagagcctgatccgtctgtttgaggggaccatgctccttcgggacagccagacagccagcaaatacagtcaggtgctggaggaggccagggcgttcatccgtgagaactatgccaaggaggagatttcccttaacacggtggctgccagggtgaacatcagtcccagctatttcagctccatattcagccaggagatgggcgtgacctttgtggaatacctgaccggcgtcaggatggagcgggccaaggaactgctcatgtgctccaacatgaaaaccactgaaatcggctatgaagtcgggtataaggattcccactatttcggatatctgtttaagaagacagtgggatgcacgccaaaagagtaccgggcaggaagcagggagcgcttatgagggcgcccggacagttccgggaaagggaaaaacggcttttagaccgccttcccctggaaaaaaggctgaacaccatgacattcatcatcatcatcccgctgaccgtgctggtcatctatcttatggccactgtggtgaagttctgcaatgcctataaccagagcattgtcaacatcacggatgtgaataacagcatggcgtatttccgggaagacctggactacaccatgtaccggattgcaatcggcaccatgacctaccaggatatccatgatatgcctgaggaggacaggccatatggatgggaacagataaaggatccccatgagatgattaattccaccaggaaggtgtaccgccagctcttaaagcggaccacggatgatgggaaccggcgcaggattacctggatcatccactgcctggaccagctggaggacagggtcaatgagatagaggacaaccttccctacggcggctatgacaagaacatgcagcttctggacatgggagtctatatgctgacagaggatatcgcggaacagagccaggaatacatctactatgagacgcttcatgtgcaggaaatccagcggcagctggaacgccaggaacgcacggccatggtggtaagcctgagcctcctggggatgatcctgggcctgggcctgatcctcagccgcaggataacaaagagcgtcacggagccaatccagaaattatgcaacgagacggaacgggtggcgcggggggactttacctcggggccgaagattgaatcaggggatgaactggctatcctcaccggaagctttgaccatatgaaaggggaaatcggccgtctgattgaggatatacgccaggagcagaaccagcgcagggtcatggagctgcagcttttgcaggagcagatcaatccgcatttcctctacaacaccctggacaccattgtatggctggcagagggagggcagaaccgggaggtggtggacatggttacctccctgtccgaattcttcaggaccaccttaagcgggggaaaggatttcataaccatcaaggaggagatgggccatatcgagagctacctgcagattcagaaaatccgctaccaggatatcctggattatgaagtgacgctggatgaatccctggaagagtaccgcatactcaagcttaccctgcagcctcttgtggaaaatgccctctaccacggcattaagaacaagcggggcaggggccatatctgggtccggggatatgccagggacgacatggctgtcttcgagatccgggacgatggggccgggatgacgcaggaggaaatggaggcggtgcagcgcaagcttaagggcggggaccggccttcggacaggaacggatcagcctccaagggcgggttcgggctgttcaatgtggcggaacggctgaggcttaactatggagggcggtgcagcctggaattccacagcgtccagggagaggggaccactgcgctggtatgcatccctctggacatggaatatgaggctgtttaaaaaatccccccttttttcgtaaaaaaacacccggaagtatgaacaaactgtgaaaattcgaaaaatcgtgtacaaaacaacggagaaattccgttgtttttgttatttacaactggtatcatataaccatcaacaaggggaaacaaaacatcaaatctaaggaggtttacgtattatgaggaagaaaacattaagtgttgtattaggtgcagcaatggcagcgtccctgctttcagggtgcggcggaggaagcaaaccagctgacgcaacaacggcggctcccgcagcagagacaaccgcagctcctgcagctgacacaacagcggctcctgaggctgacacagaggctcccgcagctgaggcggcatcttcagatgacctgatcgtggttggatatgcccaggtcggagctgagtctgactggaggacagcaaacacagagtcctttaaatccacatttacggaagcaaacggatataagctgattttcgatgatgcacagcagaaacaggagaatcagattaaggccatcagaagcttcatccagcaggacgttgattacatcgtggtagcgcccgtggttgagaccggatgggaagcagtccttcaggaagcacaggaagctgggatcccggtcatcctgtccgaccgtatgatggatgtggatgaaagtttatatgagtgctgggttggcggcaacttcatcaaggaaggtgaggacgcgggcaactggctggctaagtacttagaggaccagggcaggggcgatgaggaaatcaacatcgtaacccttcagggaaccatcggagcatccgcacaggttggccgtacggacggttttgcaaacatccttgcacagcacagcaactggaagatgttagataagcagaccggtgagttcacacaggccaagggccaggaagtcatggaatccttcttaaaatcctatgacgatatcgatgtggtagtggctgagaacgataacatggcattcggcgcaattgatgcaatcaaggcagcaggcaagacctgcggacctgatggtgacatcatcatcttctccttcgacgcagttaaggcggcatttgacgcaatgatagcaggcgacttaaacgcagcatttgagtgtaacccacttcacggaccacgtgtggatgaaatcatcaagaagctggaaaaaggcgagacggttgagaaaatccagtatgtagacgaggcttacttcgatacatccatggatctggaagccatcaaggctgagcgtgcttattaatagtcattagaggaaaggcggtggggagagtcgtttcacggctctcccccttttagggcctggcagccaggcagacagcaaaaacgtgccctgtggatggggcggaaaacggtagaaaggcggaaatcgcatggagcagaacgttgttttggaaatgcgggggatcaataagaatttccccggtgtaaaggcactgcagaatgtggattttactttgaggaaaggcgaaattcacgcccttatgggtgaaaatggtgccggaaagtctacgctgataaaggtgctgaccggtgtggaggaatttgagaccggcacaatccgaattgatggttcgtccagcacaatcatcaaccggtcgccccaggaagcgcaggaaaatggaatcagcacagtgtaccaggaggtcaatctctgtcccaacctgtccgtggcagagaacctctatatcggcagggagccaaaacttgggcctatgattgactggaaggccatgaagaggaatgcgcaggaactgcttaagagcctggacatctacattgatgtgacggcggcagtggagaattactccatcgccatccagcagatgatagccattgcccgggcagtggatatgtcggccaaggtattgatactggatgagccaacctcttccctggatgacggtgaggtggagaaattatttgtgctgatgcgccagctgcgggataagggaatcggaatcattttcgtgacacatttcctggaacaggtgtatgcggtctgcgacaggatcacggtcctcaggaacggaaccctggtgggtgagtttaagacagaggaactgcccagggtacagctggtggccaggatgatgggtaaggattttgatgacctggcagccattaagaaggaaggcgtttccacggtaaaggaggatgtgatcatccgcgccaagggactgggacataagggaaccatcaagccctttgacctggatatccacaaaggcgaggtcatcgggcttacaggacttctgggctctggacgttccgagctggtcagggtcatctacggagcggataagcctgacagcggggagctgaccgtgaaggggaagaagttaaaggccagcacacccattgatgcaatgatgcagggaatggcgtacctgcccgagaaccgcaaggaggaaggcatcatcgccgacctgtccgtgcgtgagaatatcatcattgcccttcaggccaaacagggcatgttcaagctgatgtccaaaaaggaacaggaagaatttacggataaatacattgatatcctccagattaagacggctgacagggagacgcccatcaagcagctgtcaggcggcaaccagcagaaggtaatcctgggaagatggcttctgacccagccggatttcctcatactggatgagccgaccaggggtattgacatcggaaccaagacagagatacagaagctggtactcaagctggctgaagatgggatgagcgtggtgttcatttcctcagagattgaggaaatgctccgcacctgcagccgtatggcggtcctgcgtgacggcgagaaggtaggggagctggcagagggcgagctgagccaggattccatcatgaaggcaattgcaggaggaggggaagaataatggaaaaagtgaagaagataacaggataccggctttttctcccgctgtcctgtctgctcatcgtactgctgatcaacctgataacaacgcctacatttttcaagatatccattaccaatggagtcctctacggctacatcatcgatgtcatcaaccgtgccagcgagctggtagtgctggcagtgggcatgaccctggtggtgtccgcctcggctggtacggatatttccgtgggcgcagtgatggcggtggctgcttccgtgtgcacccgcatccttgcggcaggggaggtgtcggtcaatgaatacgccaacccttatatcctggcggtcctgggaggcctggccgtggcggttgtgtgcggctgctttaacggtttcctggtggcgaagctgaagatacagcccatggtggcgaccctgatcctgttcacggcagggcgcggcatctcacagctggttaccaacggacagattacatatatccgtgtggacgcatataagcttctgggcaacaatattccgggaatccccatcccaaccccgattttcgtggctgtaatcgtggtggccctgacctatgtgcttctcaagaagacggcccttggcatgtatatacaggcagtgggcatcaatgagcgggcctcacggctggtgggacttaaatccaccaagatcatctggctggcctatgcgttctgcggcctatgcgcaggcattgcaggactggtggcatcctcccgtatctattccgcggacgccaataacatcggtcttaacatggagctggacgccattgcggccgttgccctgggcggaaattcactgggagggggaaagttctcgctgctgggttccgtcatcggcgcctataccatccaggccctgaccaccaccctgtacgccatgagcgtgccttccgaccagattcccgtgtataaggcaatcgtggtcatcctgattgtggcggtacagtctgaggaacttaggaaactgaaaaagcgcatgactgcaaaacatacatccaagacagtggaagggggagcggcataatgaaaaacagcaataagaaaaaactggacggcaactccttcctgctggtcgtgactatcgtactgttctttgcaatgtacattgtgggtatcatcatgttcggtgaccgcggatttgcaaaggtacagaattttctgaacctgttcatctccaatgccggactgattgtggtggctaccggcatgaccattgtcatgattacgggcggcattgatatttccgttggctccgtggtggccctcatatgcatgatgctggcatggatgatggaaaaggcgggaatcggcgcggttccggcaatcatcatcgtgctcatgacaggctgtgtgttcggcctggtgcagggctttttggtggcgtacctgaaaatccagccctttatcgtgaccctggcaggcatgttctttgcaagaggcatgacctccatcatcagccaggagatgataagcattaacaacgaaacgtttaaatccattgcaacctttaagatgtacctgccctttgggggatacctgaacaagaagggaatcatgatatacccttatatctatcccagtgtcatcattgcccttgtggtgctcctgctgattttcgtggtgctgaaatatacgaaattcggacgctccatctacgccatcggcggaaatgaacagtcagccctgcttctgggcctgaatgtcaggaaaatcaagcttcaggcttacatactggatggcttcctggccggacttgggggactcctgttctgcatgaatacctgttccggtttcgtggagcaggccaagggatttgagatggatgccattgcatcatctgtaatcggcgggacccttcttacgggcggtgtgggaaatgtaatcggcagcctgttcggagtgctgattaaaggtaccattgaatcatttatcaccttccaggggacgctgtcttcctggtgggtaaggattaccattgcggcgctgctttgtttctttattgtgctgcagagtttgattgcggcgtttaagaggaagagtaagtaagagatgggcgtttggcggatgaggctggcggaggctgcgtccgcggaggatgccaggacgggcggcggtttgggcgctcagttccggaggccgcagcttctaagaccctgacaggcggaaagacgggggaccggtgctattcgctgagaaatcctgatggactttctcagctcagagcaccttggattcttgctttgatgcaggaatccacccccgtctttccgcctgccagaatctaagaagctgcggcctcctccacaatgcgcccaaaccgccgcccgccctggcatcctccgcggactggggacttccggccggatatgggccaaatggccaggaaggcaggtcaattgtttcaatggtggttagaggcgtaggatttcgatgcctaccaggcccggaccggtgtggacggccatggaggggacgatggatttctccatgatgagatgtccgcttggaatgcctgaaatcagcctgggacgcagggcattggcagcttcctggccctggccgtttaacagtgcggtcaggcatgggccgctgccggcaaatgcccgggcttcttccaacagcctggactgcccatgtcttgctccgcgtatcttggcaaccgtgtaataaacgccgtcatcatcacaggagatgatgggcttgatgtttaacatgctgcctaccacggaggtgaccaggccgatgcggccgcccttgcgcaggtaggtcagtgtatccatgtaatagaatactttggaatccttgactttctcaggaagtatttccgtcagttcatcaaaggtttttcctttttctaattccatggcagcccagacagccaggactccggcgccaaaggatatgttccgggtgtccaggacaaaggtggtcaggtccttttcctgctccaggacgcagcataccgtgttgtaggtcccgcttaaaccactggatatgcagaaggccaggacatgggtgtacccttctgatttgatttcttctgccatgctctgtacttcctggggactgggggtggatgtgatgggaatctcacgggggaaacgctgataaacggtttcagccgtgatgttcatgtcgtcaacataatccccttccgggtaaatgacatgaaggcgcatcaccttcatgtggtatctctgaaccagctcttctgatacatcgcagccagagtcaattaatattgcagtcttcatacagcacctccgtatgtagtatttaaaactatatattaaagtatctcataatatataggctgtgtcaaggtgaaaggttggatggaatgtaatttataaataaagttgtatgtacaaatttttgagaattaaaaaagttatcaatacttattgacaatgatggatgaaaaatgtatagtaggagtatagaagatttattggagaaatgaacggaattgattggaaaatttatgggggaatcagtgaaaagtactgatgactgcatgggctgggcggtaagattcgtttggtgttgggaaatagcgaaagataaatggattgttggtataaaacaagttgtacgtacagaagtgctggtggtgtaggtctggtggtatgagacttggtgatgtggctggtggctggtggctggtggctggtggctggtggctggtggctggtggttgatggttgatggtcgaaaactgagaattgatgattgatggctgaaaactgaaaactgaggactgatgattgaaggctgacatatgagaatcacgccctaagactcgggaatcaggattagatggatgcaggcatgaccgggggatgaataaggaaaaggaacagggatgcttatggggatacaggagcctaagtataaggcagtttataactggattgttgataatatcaacagcggggagctgaaggcgggagacaggcttccttcggagaatgagcttagtgcgcggtttgggctgagccgtcagacaatccgccatgccattgaccttttaggacagcagaagctggtgaccagggtcaggggcagcgggacctatgtgggcggggaagtcaggcagggacgccgggagcggtatatgaatattgctgtcatcagtacgtatgtggacagctacgtgttccccaccgtgttaagggagattgagagcgtgctgtccgggaagggatatacgacccagattgcatttacaggcaaccgggttggcagggagcaggagatattaagtaacctgattgataaggatatcattgacgggctgattgtggaaccggccaagagcgccctgcccaatcccaacctgcattattacagggaactgatgaagcggcagatacctgtccttttctttaacagcaattatccggaactggggctgccctacgtggccatggatgatgtccgggtgggaaggaaggctgtggagtatctggtgaaggccggacacgggcggattggaggcattttcaagtgtgatgacggccagggactccttcggtataaaggattcatgcaggggatgcaggaagccgggctgagggcaaaggaccgcagtgtggtatggattgattcagaggatctggtggatatggaatattggtcggactatctgtttcgcaggataggggactgtacggcccttgtgtgctataacgatgaggtggcttatatactttcaggaatctgcgaaagacggggaatccgtataccggaccagttatcgctggttggcattgataattccgagctttccacactggccgatgtgcagattacatcccttccctatcctatggaggaactgggcaggaaggcggcggagaatattgtgaagatgattgagaatccgtgttttgacgggaattacctgtttgattcagatgtggtggaacgggtttccgtgaagatacttggcagtggcagctaaaaggaggcggcttatggagaaagggaaggacaggggaggcgcaaaacctcttcaggcaacggtggtcatacgcctgattgcgggagggtatctggtgtatctggcccatgatttatttaagatttatcttaatcccgcggagggcgggaagatttaccagctgggatgtgctgcgtttttctttgcagtgggggccggactggctgtctggtctggaatgaagcttataaaaggtgattatgtgaaaaacggtgaacgtgctgatggaggggaaacgcagacggacgaagaatcggctgaggatgcgggagcggctgatgggacaaaagaagctgcggaggaaacgcctgaggcagatgacaccgaaaaaataataaatattcaggaggacgatggaaatgataggagttaaaagttataagttctggttctgtaccggttcacaggatctgtatggggatgaatgcctggcgcatgtggcggagcattccaggattattgttgacaacctgaaccagtcgggtatcctgccctatgaggtggtgtggaaaccaaccctgattaccaatgaactgatccgcaggacctttaatgaagctaattctgatgaggagtgcgcgggcgtcatcacatggatgcatacattttcaccggccaagtcatggatcctgggacttcaggagtttcggaagcctctgatgcatttccatacacagttcaaccaggagattccctatgacaccattgacatggatttcatgaatgagaaccagtccgcgcatggggacagggaatacggacatatggttacccgcatgggtattgagcgcaaggtcattgtgggacactggagcgatgagaaggtgcagggacgcattgccgggtggatgcgcaccgcggtgggcatcatggagagcagtcatgtaagggtggcaagatttgccgataacatgaggaatgttgctgttaccgagggcgataaggttgaggcccagatgaagtttggctgggaagtggatgcatatcctgtgaatgagctgtgcgaatatgtgaaggcagttccaaagggggatatcacggccctgttggatgagtattacagtaagtacaccatcctgttagagggaagggaccccgaggaatttaagcgccatgtggctgtccaggcccagattgaggctggccttgagaagttccttgttgagaaggattatcatgcgattgtcacacatttcggcgatttaggcgagctgcagcagcttcccggcctggcaatccagagactgatggaaaagggttacggattcggcggggaaggcgactggaagacggctgccatggtaaggctgatgaagatcatggcccagggagtgaaggatgccaagggcacatcctttatggaggattatacatataacctggttccgggtaaggagggcatcctggaagcgcacatgctggaggtctgcccgtccattgccgacggggatatcagcatcaaggtgaacccgctgtccatgggtgacagggaagaccctgcaagactggtgttcacatccaagacgggtcacggaatcgccacctcgctggtggatctgggaaccaggttccgcctgatcatcaatgatgtggaatgcaggaagacggaaaaggcaatgcctaagcttccggttgcaaccgcattctggacaccggagccaagcctggcaaccggagcagaagcctggatcctggcaggaggcgcccaccatacggcattctcctatgacctgacggcggagcagatgggcgactgggcagattccatgggcattgaggttgtgtatattgacaaggatacaaccatccggggcctgaaaaatgaactgcgctggaacgcagcggcttacagataggaaaacgcgggtgaagccgcagccgggatgacggctgcggctcccggtgtttcaatgaaggaggggtaattcatgagtttagatcataatgcagttaaggaaggaatcgaaaagggaaatacatcgctgggaatcgagctgggctccaccaggatcaaggcagtgctcattggggaggaccatacgcccattgcctccggaagccatgactgggaaaaccggtatgtggaccatatctggacctataccctggaggacatatggaatggaatcagggactgttattcaaagatggcggctgatgtgaaggaaaggtacggcgtaacccttaccaccattggttccattggattttccgccatgatgcacgggtatatggcctttgataaggatgggaagctgctggttcccttccgcacatggaggaataccattacagggcctgcctctgagaagctgacccaggttttccagtacaatgtaccccagagatggagcattgcccatctgtaccaggctatccttaataaggaggaacatgtaaaggatattgattatctcattacattggaggggtatgtgcactggatgctgaccgggaagcgggttcttggcattggcgatgtggcaggcatgttcccggtggacatccatacaaaggattttgaccagaagcggattgaccagtttgatgaactggtggcaggggagcatttcccatggaaactgagggacatccttccaaaggccctggtggccggacaggatgcgggcgtattgacagaggaaggcgcaaagctgcttgatgtgtccggaaacctgaaagccggcatccccatgtgtccgcctgagggggacgcggggaccgggatggctgccaccaacagcgttgcggtgcgtacgggcaatgtttccgccggtacaagcgtgtttgccatggtggtgctggaaaaggagctggagcatgtgtatcctgagattgacctggtaaccacgccggcaggcgatatggtggctatggtgcactgcaacaactgtacgtccgacctgaacgcctgggtaaacctgttcagggagtttgtacagacaatgggcatgaaggtggatatggatgacctgttcgggaagctttacaacaaggcgctggaaggggacgcggactgcggcggactgctggcgtacaattatttctcaggagaacacatcacccactttgaggagggacgcccgctgtttgcgcgtatgcctgacagcaggtttaaccttgccaacttcatgagggtgcacctgtatacttccctgggcgcccttaagaccggcatggatatcctgttaaagaaggaaaatgtgaaggtggatacccttctgggacacggcggcctgtttaagacaaagggcgtgggacagaggatactggcaggcgcaatgaacgccccggtgtccgtcatggagacggccggtgaaggcggcgcatggggaatcgcgctgctggcatcctatatgaggaaccgggaagagggcgagacactggatgcatatctggcagataaggtctttggcggtgataagggcatcacggtggaacctgttaaggaagatgtggaaggatttgaggcattcatggagcggtatgcagagggccttgccgttgagcgggctgctgtggagcatatgagataggaaacaggatagaagggcttcaagggctgcgggcggccggggtgacggaaagcaatgtttagacgcgccctgagatgccgcctggatatggatgattggatacggttgaaaatgacggaggaacaaaaatgttagaggaactgaaacagattgtatatgaggcgaacatggaattgcctaagagagggctgattacctatacctggggcaatgtcagcggcattgaccgggaaaaaggcctttttgtcattaagcccagcggtgtggattatgataagctgaaggcatcggatatggtggtaatggatttggacggcaataaggtggagggggatatgaacccgtcctccgacacgccgacccatgtggagctgtacaaggcatttaaggaaatcgggggcatcgtgcacacccattcccctcatgcggctgcctgggcccaggccggaagggcgcttccctgttatggcaccacccatgcggactatttttatggggaaatcccgtgcgcaaggaacctgaccgcccaggagattgaggaagggtatgagatgaatacgggcaaggtaatcatcgagacctttgagggtaagaatccggtgtatatcccggccgtgctgtgcaagaaccatgggccgtttacctggggcagggatgcggctgaggcagtgcataacgcggtggtcctggaggaagtggctaagatgaacttcatgacggaaatgctgaaccgccaggtggaaccggcgccccagtggctgcaggataagcatttcatgcgtaagcatggaccgaatgcttattatggacagggacataagtagggaatggattttcaaacacgcccgggattgttgagtggcgcatcgcggtgtgtacgccgcgatgcggaatcggaagtgcggattcggaagtgctgatatagtgtgcacatgagaagaagcggattgggtaatatgtatatggaaaatgcaggcaagacaaacatggatttttaccgccgggtaggaatcgtgctgagggctgttcctgagggacgtgtggtatcctatgggcaggttgcccttctctgtggcaggccaaagaattcacgtcaggttgggtatgccctgaggaatgacctctccggaccggttcctgcccaccgggtggttaacgggcaggggtatctgagcggtgcggccagctttgattatccgggactgcaaagacgccttctggaggaagagggcgtgaaggtgtccggggataacagggtggatttaaaggagtttggctggaagaataccatgatggaagcagaaatgcttctgaggcaatttgaaagggagaaaatctgagaccagagtagcggttatccgtcactctggtctcaatctgcatacttcattatatagagttaaattggtccggcggctccgcagatgggatatttattgtatgacggcattggaaaggatgtaaaattcttcctggcccgcctggtactttttctccatcccttcaaatccctggtcaaagcgctgggcttcttcttcatcgattttcatggcagggctgtcgcggtagaaccatttcctgccgtccaaagcatttggcttaagttcctttgccatcatcgctgcgggataagttccgttctcagcgcagatgttatactttttacagcttttaaagccacgtccgacgtaattaccgggattcccgaatattacaatcacatcgtagccgagttcaacggcctttttaaaggaatgttccattaatgatttcccatatcccatcctctggtattcgggcagtatggataccgggccgaaggtcaggatttctttttcttctccggcctcatcggtcagccaggattttgtatacatgatattccctacgatttgatggttgtcttcgattacaaaatccagttccgggagaaagtcctcgtgggaacgcatgacatgcacaagatagtgctcggcgcaccctgggatgtatatgttataaaaagcctttcttgtgagttcctccacagtcctgtagtctgctgcttcttcatttctgattttaatcatataaaaacctcctactggttttattatagtataatgagtttggcatggcaatcttatttatggaatcagtcctggaccaggcctggataattatggttagtatttacggtttcgatacaaggaggacgctggacgtgtttgcgccgggcggcactgggacagatatgctataaaaagattttggaaaataagttaggaattgtaaaaagtgcataaaaaaatagaagcaattttgaataatatgtttattgtactaatgctaatatcatgttattataaaaacataataagttaggagtgaaacagatggcaacacaatttatagataaaggcaacaatatccccctgtaccttcagcttctgtctattttcatggaaaacatcaggaagggaatctgggaagcaggggagaaacttccttcggaaaaggaactttcccatacatatggggtatctttgattacggtcaggaagacactggaagaactgaacaagcagaacctgatttacaagatacagggaaagggcagctttgtatcctacggggagtcggaaaagtataatctccggttcaaggagctgcggagttttacggaggagatggagcagagccgcaggaccgtaggggcggtagtcctcaaagtggaagaggcggccgtggattcccgcaatgcaggtgactttgggattcctgaggggacccgtgtgcttcggattgtccgtctcaggacggttgacggtattccgacccatataagtacttcggaggtttttccgggaatcggtgagaagctgaaggattgtgatttgacccagtcaatttatggacaccttaggcgtttggggcatcagctgagccatgggacagaggagattgtggcggccatgcctaccagggaggaggccggatatctaaaaatcagctgtgatacgccggtgctggatacccggagtattgtagaggagaatggaagaccgatcctgattacccggtcccttattaatagtaaacggatgaagataacggtggaacttgcaggagaagagtaaggatagagctgggtgccagcttttccttttcatctaacatattatgtttttataataacattataacgagaggggggaataagatgtcgaaaaagggaatagcggttctggcggtcgtgttactggtgcttgtgattgccggcgcccttatgggtggggtgaaggccggaacacctatgttccaggccgtgggagcggtgcttctggttgttgcgctggccatgttttttatgaagaagaaagagtaaaaggagaatgaggtatggaaaactatttgggaattttaagggtattgggtgctatatcgttcggtcttgggggaatcgcatttttactgtcattcaaatggaggctggacgggctgaagcttgtgaaacatcatatccgctgggacgcttctgtgattaccataatcgcaatatctgcggcattaaatgccggggcggcgattatcacaggaccgatccggtttggatggatcagtttccggccgggagcggcaattactcctgtgctgggaatcctttttgggatacccggggccattggggcgggcctgggaaatgtgatttcagacatattgaaaggttttatctcacctgccagcgtcagtggttttttggggaatttcttcgcatttgccctgatacccgggatgattgtaagggatgcttcactaaagaacaaaaacagctggatgcagtatattgcgggcatatgcatcggcgccggatttgggatgttatcaatgccgtggttcattgatgtgacggggaccatgcctccggtggcggcatggacaacggaaccctttgccttgctgatgaacaggattttgtcaccattgctgttaggaccggttttcctgaagattttatatccttttacagttaagaatgggatgtactggaggcaggagaacaccactaccgtagagaatctgtaaaggaaataaggagatacaatgagtgaaacattaataaaagcgaaaaatcttaaattccgctatcccgggacggataagctggctttggatgatatcagctttgagattcacaaaggggaagtgattgggatcatcggacctaacggcgcgggaaagaccacactctgctctgcaatcaaagggattatcccgcataaaacaggaggggcatggggtggggagctggaggtctgcggattgtcagtgcggactggatctactgcaaagctggtgccccatgtatccatgacatttcaaaatccggaaacccagatactgggtacaaccgtggaggaggacctggcatttactccggaaagccttggcatggaaccggaggaaatccgcatgaggatggatcaggtaatggaaacagtaaggctgcctctggattacaagaagagggctccgttccgtatgtccggcggggaaaagcagcggcttgccatcgcggcttccattatttccgcaccggatatcgtaatcctggatgagcctacaacggagctggatccggtggggaaggcggaagtccttaaaatcgtggggaatctggcgggaagcggggagaatacagtaatcgtggtggagcaggatatcgattatcttgtaaccgtggcggaccgtcttctggtcctggaggaaggaaaactcattgcccaggggcccacaagggaagtgatggccaggacggaattcttaaaaaaggcaaagattaatgttccggatgtgtctcttttatggaagcagatggggtttgacggtaaatacccggtattccttaccgtggaagaggccagacgtgcactggccctggaagggctgacacaaacagaagcatcagctgttgacagacatgaggcaaaaacaggggatggggaaaggcccgaggcggctgcttatgagcatacggtgttttcctacggcgaacgggagattttgagcgatatcagccaatccatacagaccggggattttatcgcggtactaggaaaaaatggagcgggaaaaaccactatggtgaaacatctaaatgggcttttaaaacctaccggcggtcatgtgtatgtatgcggaagggatacggcagcctgttccgtggctgatttagcccatagcactgcgtatgtgttccagaatccggatcaccagctgtttaaccagaccgtggaggaagagattgcctttggtccgagaaatctgggatgggatgagggaaaggtgaaggaagcagtggaacgggccatggaaatcagcggactggaggaatggaggaatgagacgcccctgtctttggagcgcggattaaaacaaattctgatcctggcctgtgtcatagccatggatgtggacatttttgtggtggatgagcctaccacaggactcagcaagtctttcaaggaccggatcggcagtatcctggaccgtctgaatcaggagggaaagacaatcctgctggtgacccatgatatgcagtttgtggccgagcatgcccggaatatctgggtggtgcaggatgggaatattaccctgcagggaggaatccgggaggtgttcagggagaaggagcggctgcgggaggcatatctgttcccgccgcagataacacagcttgggctggaactgggctggacatctgttttgcttaataatgaagaatttatggaggtggccggatatgaatgcagtaggcagttacattgaccgggattcggtgattcatcatctgcatcctgtcacaaagaatctgttatttatcggtacattcgtgatttgccttttaacgaaccatccggcaatcctggcagggctgttcctgggggtaatccttgtaggcgcagcggcaaagctgccaatcggccagtcccttaagctgttgaaaagcgttgcattgctgattgtgatattttccctggtaatctggccctttacgctgaaggagggacaggtgctggcacaggccggagggcttaaggtttattcggtaggcgtctggtatggaattgccatgacgttccgtttctgcaccattgtgctcatgagtatctactggatgatgttcaccagtatcagtgagattactttgggcctggtaacactggggatgccgtataagatggcattttccttctcaatgtccctgcgttttgtgccgttaatcatcaacgatcttcataccatcaaggacgcgcagcggtcacgggcgctggagatggacaaagggagcctgtatggcaggattaaaaagaatgtggcaattttgattccgctgtcctcaagggccctgggactgattaaacagatatccgtaagtctggaggccaggggatttgaatcgggaaacgggaaacggacatccatcagtaaacggccttttaccggccgggattttgggatgacagccggtcttgtgtgcctgtttgcggcgcttgtattgttaagggtcacggcagtgggcctgattacaacatcagtattataaagggaggtttttatgcaggaatatcgggatatgatgacggagattgaacggcaggggagtctgggcccgggtttaaaacagattgaggcagcggtagcagagacctgtaaggaaattatggaaaaggggaagaacagaaaaatctttttcctgggatgcggggattcctactttgcggggctggctgttaaaaattatttcttgaaaaagacggacagcctctgctttccgatgacagcactggagttctccacatatgggattcaccaggtggatgaggagagcacggtgattgcggtttctatgtccggcaacgtggcccggaccgtggaggctgtgaaggcggcacaggagagaggggcatatgtggtgggaatcaccaattccctgaccggacgtctctatgaagtgtgcagccaccctgtttttctggggcttaaggaggaaccgggctggacgcctgggacattaacctacaccggcaccttatatgccctgttctgcctgggcgcagggcttagccgggaatcagaaagggatggatgccaaaaggaactggcacggacaatggaactgatttcccatgtggttacccagtgccaggatacggcaaggcaggcaggagagaactttatctataatggacatcagttccctgtctatatactgggcgcaggtcagagcttcgcaacagccaaatacggggcagccaaattcctggaagtctgcggggtgaccgccataggccaggagagcgaggagttcgcgcatcaggaattctgggtgattgataagaactgtccggttttccttgtggcgcccaagggggacagtttccagagaaccatggaggttggtgcgtgtctccgccattttggctgcgacctgtttgtgatttccaatagtgaggaactatgtgatatggggaaatatgcgtttgccatgccggaggatgtggaggaattatatgcgcctctgctgtatgcggtccccatacagctgacagcttattatttttccaggaaactggggctggatccggaccgcaggagccataatgacccgttccggaaaaaggtaagccggatgttgacaagaggaaccgttaatcttgattagggggattgggatgggagaggaaaaaatattggtggcaggtcatctttcactggaccggattaaaaccccggaccgggaagaaaaccaggttcccggaggagcggccttatatacatcggtggctgccagcgtatatggcgggaccaccgggcttttaaccacctgctgcagtgatttcccgggggaagtattgcagcggattgaaggtttggggattgatgtgtctgaggtacttccggtgcttggtgagcagcggagaagcttcatggaatattcggaacagtttgaaagggtgacacatagccatgccaggaagatatggtatgagaaaaccttggaacagaccccaagacatctgccccgcaaagaatatacggtcctggtattgccgcccatgctgccggctgttcagctggaatatgcgaaatgggcgaaaaaacgcggaatgcaggtctgtgtggataccagtgaatattttgctgaaaaggacggggaaagcctgagggaggttttaagctggtgtgacatattcctgccctcggatgtggaactggacctgctctggccgggctgcggggattccgcggagacattgataaggcggctggccgcaacctccattaccgcagcagtgataaaacgggcggaacagggagctgatatttatgatttccaaagcaggacagcctaccggattggaatccggcatacggtggtaaaggatgccactggcgcgggggatacgtttaacggcggattcctgtccgcctggtgcaggacaggggattggaaaagcagcggcacatatggggctgccctggcttccctgtgtatcgaggcgtttggctttgagggagtggcagggaggaaacgcagtgaggtggaaaaactggctgggcaggtgccggtagaggaatggggattttaaggacaatcctctatgccgggaaccggaatgatgaaaagagttggatcaggaggagatacaggatgggaaagtcatgcaggataacgggagtggttcatcttccgcctttcggggcagacaggcttgatttggaagggctggaaagctggctgctggagcagataggcatacacgcggaatgcgggatcacaagtatgatgatacaggaccagacgccgggagagctggccggattaaaacacgtggccatcctttcggccctgggcagaacggtaaaacggatgtttccggatctgtccctggggataatactggaggcaaacaacccttctgccgcaatgtatattgcaaatgcctgcggcgcggacttcatcaggcagaaagtgtttatcggagccatggttaaggcaggaggcgtaatgaccggccgcgcaggggaagtatgggaagcaagaaaagacatggatcggcctgtccgtgtacttacggacatctatgaccgtacaggtgtcccgctgggtcctcttcccattgagacggctgccggacaggcgttaaagtacggttctgacggtctgatactgaccgggaagaactttgaggaatccctggacctggcggaccgggtgaggaaacagtacccgcaggcccctgtctatctgggcggaggcatcacggagaaaaatgtgggggaagcagttaaacactgcgatggaatgattgtcagttcctgccttatggaggatgggaaggataatgtctggagcaggcagaagataagaagatttatggaatgtgtctgtggataatgaaatacaagctcacttaccatatatggagaaaaattatgtagtgaatatttagccgatttttgatgttgtttagaatataatttcccatttatcaacccgggtatttattacaatagaaatagcaagggatttatgatataatcagaaacagaaagcaagaacgagggctataattatgagcgatttatcatatactacttctatggtacaggaaatcaaagaattattatccggcgcacgtcagcgtgccgcggtacaagtcaatacggaattgctgtctacttactggaacatcggtcgcattattgtagagcatgaacaaaatagtcaggaacgcgccgcttacggaaaacagacactaaaagaagtatccaaagagctatcagaagaatttggaaaaggcttttctgtttctaatattcaattcatgcgccgcttttatctgacctatcaaattcaacagacggtgtctgttgaattgtcatggtcgcattactgtgagcttttgacgatttcagatgatgataagcgccgcttttacgaaaaggaagcaattaactccgggtggtcgatacgggaactgaaacgtcagatttcgacctctctctatgagcgtttgctgctgtcagacgggaaagccaacaaagaaaaggttcttgctcttgcagaaaagggaatagaaatggcgcggcctgcagatatgataaaagacccgtatgtctttgagtttttaggtctgccggaaaataagccgcttatggaaagggagcttgaaaaggctcttgtcgaacagatagaaaaatttctgttagaattaggacgcggttttatgtttgtggggacgcagcagcgcgtcacgttgaacaatacacattattatgtggatatggttttctataacaagattctccgcgcctatgtcctgatagaattaaaaatggttaagcttatgccggaagccgttggacaactaaatatgtatttaaattactatgcaacagaggtaaacgatgaacacgacaatccacctatcggcatcatcttgtgtacggacaaagacagcgtagccgccgaatatgcattaggtggtctttcaaacaatatctttgcttcccggtatgtttcttatattccaaacaaagaacagcttatcgcacaagtggaagcagtattgcaggaatggcatagtgaaaaaaagtaaaaaagacagggcacggtagccagcaaaaaaaattgccaccgtgccctgtctttttatgggtgcagttttatggcgtctgttacgaaataggaagccgattacaaggaaacaggtatagtttccttgccgcttgatacgaggctttgtctgccatgaggtcttgcatggtttcctcaaagtcagccaaaccatatccgcgaatggctccgcgattgctccggccacaaggtttatcttattcttactgattttgccagaatgaatgccggaataattacgatttcatttccccaaaaccctgctataataaagttattattgtaattggaattgaaagaagaaaggacgggcacattatgctgatggaacagggcggcaggaagctgcgggaatttacagaggccagttatcaggagacacacacaaaggttacggacgggatatggcacatatcggggctgggacacagcaatgcggtggtgattgagggggaatccggtgtaatcctgattgatactttagattccctggagaggggcaggaagctgctgtcaatcatccgggaaaagactgggaaggaggtggggacggtcatctatacccacggacatccggaccaccgtggcggcgcaggcgctttcctggagggaaaacctgagatcattgcctttgcccctaagacggctgtgctggagaggacggagcggcttaaggatatccagaacctgcgcggtttcagacagtttggatacgggctgacggacgaggaaaacatttcccagggaatcgggccaagggagggcatggcttatggggaacaccacgcttttgtaccgccctctgttgtgtatgatcaggaccaggtaatccgcgagatagacggggtgcgcctggaaatgctccgccttcccggagagaccgaggaccagatcatggtgtggattcctgagaaaaaggtgctgtgctgcggggataattactatggctgtttccccaatctttatgcaatccgcggaagccagtaccgtgacctggccgtctggattaaaagcctggatgtcctcatgtcatatccggcagagtatctgcttccggggcatacgggcgtcatatatgggaatgatactataaaagaggtcctgggtaatttcaggactgccattgattatatactggaaaagacccttgagggaatgaacctgggcaggagtgaggaccagctggcgactgaaatcaaactgccgccggaatatgaaagccttccttatctgggggaatattatggatgtgtggaatggaccgtcagggccgtctataccgcatatctgggctggtttgacgggaatcccacccatcttcatcccctttcgccaaaagccagggcggataaaaggacggcgcttatgggcggaaggacggaggtcttaaatgcagccagaaaagcctgtcaggataaggagtaccagtggtgcctggaactgtgcgaccagctgctggacagtgacggggatgaccgggaggcggcccttctgaaatcagatgcccttaaatccattgcagggtatgagacaagcgcaaatggaagacattactatctgtcctgcgcaaaggaattgaggggttaagtctgtacaagcagaggaaaccggtatataatgatattgctttattttagatattggaggaagaaaatatgacatttacttacccggctgtattcacaccccataaggatgataagggttttcatgtagtgtttccggatctggagtgctgcgaggcagatggtccggatctggaggatgcggtggaaaatgcaagggaagctgcctataactggctttacctggaggtggaggaacagacctacgattttccggcccagtcccatatagaagatatggagctggaggaaggtgcttttgtgaagcagatcatggtcattgtaaagatcatgccggataatgattaacggatatcaatgaaaattaagattttgtatactttgtttcccgccctttttgtcatataatggaatatattacactgctatggcatgataaggagggataaaatgagtatggcaacaggtatgggcgttttcttttttatttttgcacttttgttatacatcggtatctttgcacttattttcactgttacctattttgtattcaaaaaggcaatcaaaaacgggcttcttgaagcatacaaggaaatcgagaaaatgaaacatcaggatttccaggaataaacagatatacacagggattatcaaaaataaccagttcatacaactgcagaaagggggctgtctcccggacatatgaccggtccgcataccggtttgggtctggggacagccctgtttttgtgtatttaattcgtaatgtatttattcctggttgttctgcggcaattcataatcataagggtggcgtacaaatgcggattacttcccaagccgtatcacattccaggaacagctcttcatgaccgttgtgaaaatgccgtcctccatctgatattcctttttggggtaaggcgtcaccttttcgcctgtaagggaattaaccgccttcatatcgtcattttccattgcaagatattcgatgacacggtagccctcaaagctgtttaagtctgcttcgaatgggatatcctgtccggcgcagcggttgaccgcgaagatggtgacctcgtccttctcctcattatatacggctgcggcgtcaatgtccgttacctccccgtgcctgctggtgtcatggcaggtggagctgatcacgggcgtcagggcaatgccgcgtccatatctggatgcgtgcaggaaaggatagtagatggactggcggaaggcgccgccctcgttatccgtcataatcggcgcgattacattgacaagctgtgccaggcaggcaatctttaagcggtccgcatgtttcaggaaggtgatgaggatcaggcctactaaaagcgcgtcctcgaagtcatagatatcttccaggagatggggggctgtctgccatggacggtttgccatctcctcactgtcggatgccttggagtggaaccatacgttccattcgtcaaagcttaggttcaatgtttttttgctgcgcttcttggccttgatatagtcacaggtggcggttaccgtgtggatgaaacgttccaggtcctgggtcttggccaggaagtcctcggtgtcattgtcatagttgccgtaatactggtgaagggaaatgtagtccacgtaatcatagtcctgttccagagacacggcttcccattccgggaaggtggccatgtccacattggagcttccgcagctgacgaattccagggaggaatccatttccttcatggccttggctgtctcggctgccaggcgtccgtactcgtaggctgtcttatgtcccatctgccatgggccgtccatctcgttgccaaggcaccaggtctttatattataaggttccttcacgccgtggcttttccgcaaattgctgtaataggtgtctgtgtcaaggttgcagtattccaacaggttcagggcgtccgcaatccccctggtgccgaggttgacggccatcatgatgtcagacccggccttcttcgtccagctggaaaattctcccagtccaaattcgttggtttccagggtgcgccaggccaggtcaagacgtttcttcctctggtcctttggccccacgctgtcctcccagaaaaaattggatacaaaattgcctcccggatagcggatgatgggaacctgcagttcctttaccagctccagcacatccttcctgaagccttccccgtctgccgaggggtgtcctggctgatagatgccgttgtacacagcccttcccaggtgttcgatgaaggatccgtatacgcgcttatccaccggtgcaatcctgaaacttttatctacaatcatttttgcctttttgctgctcatgatattcctcctgaaaattggtttatgggtcattcatatctcacgcatacatatatatcctgggggtaatccccgaatttgctgccgaacaaggtcaggccgccgggattgccggagtcctcgtttactgcaaagcgcagtgtccagtaatccttttccgtatggaaatgtcccagtggcttttctgccttcagttccttgtccaggtaaacgcccaaactgttgatttcatagcgtttgaggataccgtactgcccggcgtgccaccaggaaggcgtatacctgccgcgcctgtcgccgaaatccccgggggactgccaggtgcacagatgctcgtcattgaggaaaaggtctatgtcggatacggcgtcaatcttcacatccgggtattcggaacacatttccgcacagatttctatgctggtgacctggcagtcatccggcacatagttggggatgtagtattccacatacccctttgagaaccagataagctccgcgttctcacgtcttgggtcgtagaagcagcgcgggtcgtcgtaatccccgattacgctgtgttcggttgcaatcccgcaggtaggggagatttcggcacgggtgtactggcccaccttcaggtttacatcgtaatgggtaacggccaggcgcggcgtggggaagagcagcatgtagttggttcccaccaggctgcatacttttccgtattgtttgcttttcttggattccaccagatgggcgctctccagctttttgatatgggaagtcatgatggcgctgctgacgccgacattttctgccagttccttgatgttcatgctgcgcttggacaggcagccgatgattttcaggcgcacagggcttgcaagcgcctcgaagaactccagattatcttccgatatgctgactctcataaccactcctcctcgtagcggccgcagctgcgcggccggttgtatgtcctgcttccaaatcccgcttccaaatcctgcttcctgctttcaaatccagctttcagatcctgcttcctgctttcaaatccagctttcagatcctgtcagatcctatcctttcacgccgccggcagtcatcccgtcgataaagtaagactggaaacagatgaacaggatcaggatcggtatgattgcaaagcaggagcctgcaatcaggatatcatagttgttgccataaggcgtaatcagtcctgccagtccgacgggcagcgtaatctttgtggcggtgcgcatgacaatcatgggccacaggaaattattccagctctgcatgccctggtagatgcccatggctgcaaaggacggtttcattaatggtaacataattttaaggaaaatgccatattccgtgcagccgtccaccctggcggcatccaggaaatcccttggaataccgcttagatactggcggaagaagaataccagcatggggaggaccagatagggaaggatgatgccccacatggtgtcgatggttttcatggcaatggtcatgcggtacagtggaaggaggatgatttccgtaggtatcatcatcacaaggaggacgcagacaaacaggaggttcttacccttaaagtcgtacatggcaaacccatagcccacgcatgcgctaaggaataaggtcatggccacctggacaatggtgatggtcaggctgttcctgtaccagtaaaaataggaattattgccgccaaagagctgtacatagttgttcagggaagccttggcaaagtcaatgttaaaattcagtccgttcctcatcagttcggatcccgggcttaaggacgcaacggccagcaggaccaggggcaggagggtgatgcctgccacaaggatgaagaacaggacaagacagatggaaaatgcattttttttggctttcatcctctagtcctcctttcggaacgttccgttgatgcccagctgtatcaggttgatgatcaggaccatgaccagaaggaagcatccgatggcgcttgccaggccgatgttgttctgttcccagcccatcctgtacagataacccacaatggtggtgccaacgttgttgggcgaggtgttgccgttaaacaggatgtaggattccgtgaacattgccagtccggcaaatatggatatggtcagcacatagaccgttgtgggctttaatagcggaagggtgatgtgcctgaatttctgaagggcagaggcgccgtcaatggaagcggactcatacagttcctcgggaatctgctgaagcccggacaggtagtacatcatattgacaccggtccagcgccacatgcagatggtaaaaagggcaatccatacggtcaggggctttctcagccacacaatgggaccattgcccaacatggccatgacctggttggcaaaggaaccttccagttcgccgtaaatcaggcggaagatggtgcctgcaaccaccacggatgtaagggccggtacaaacatggagcttctaaagacggtcttgcatttcatcagcttggaattaagtatggtggccaggagcatggggaccggtatcataaggcacagggtcacgattgtgtagaacatgctgttcctgaccgccttaaaaaagatagggttcataagggacttatagtttttaagacccacaaaggtattgcctgaaccggataccttctggaaactcatgaccacggtattgatgaccggatacacaaaaaagatggaaaaggtcaggataaatggcagtatgaagacatacggtgccactttctgggaatacagaaaatgagaaactatctttttgcggttcaatctcgattcctccattcatgggataaacgtatgcttgggggcgcagggattgttgatggcgccccctttcctcatactgtttgattcatacgcgggattcagatattattcatcgtaaatgacgctggcctgttcattctcaagcagctggtccacgtcctcgtccaatgaaagttcaaatgcattggtgtaggtggtggttccaagtatgctgcggacattggcgtatgcgccggagatattgggggcggtcaggtcaattccgtattcagccctgatttcgttcagcacgtcaaatggattggtcctgaagtactggatgaatttgttgttctggtcatgggtcagttccccgtcatcccaaagagaggtcctgattgggtcgaatcctaatttctcccagatatatcggttgccttcctcggacagctttgcatatgccaggaattcctttgccaggtcctggttggcggactggttagttacactggtcccggttccgccctggagcacgcagcgggtatctcccttgttccatacaggaatcttatagattgcaatcttaccgtttaagtcaggacagtaatccgtgaaacgtcccatgtaccacagcggcatggcgatggaggcaaccccggcattattcaggtggccgtaccattcctcacagtggaacttgccgccaggggcaacttcacagatgcctgcgtcaatcatcttgcggatgaaggtgatggcctcgccgtgctccggcgtatcgatgtttggctggccgtcttcggtcacatactgcacacccttttccagaagcagaagctggggaaggaacaggtcgctcagttccaccgcgcacatgggcttgccggtcttttcaagaaccgtaaggcctgcattgtagtagtcatcccaggtttcgatggtcccggggtcaacaccagcggcatccatgatatccatgttgtaatagcacacgctggcgcccagatggaaatcaataccgtactggttaccctcggaatccccgtacatgttaacacgggacatgacaatgtcatccttgtacggctctaccacgtcattgatgggcagcaggtaattatcctttaagaatgtggcgtatcttccgatttcaatatctgcgatatcaggggcgcccgtgcctgactggagggctaccagcagctttgtatgtacggcggagctttcgcctgtggtcacggtcaggttgatgggcttatccggatgggattcattccatttgtccgccatttccgtatagaagtttacgtgaagctcctggaaggtccacagcgccatctcggttccgccatccacaaaggtgttggtgcctgtggtcccgccgcccgccgggtcggctgcctgtgcggcgggcgcttctgtggcgcctgcctcggtctttgtatctgctgcaggtgtctggtcagtggtgccggccttggaaccgcatcccattaatgatgtgcttacaagtgctccgcataataacatacttaataatcgtttccgcataattccctctccttttaaacagttgtcatccattggaatcacattaaaatataaagttgaatacacgtgtattttgctaaagctaaatcgaaaagatgtttttaagatttagttttaagttaatattattataatggatatgtgtataatagtcaatatataagaagtatagtttgatatttttggatataatgcatataaaatagaaataaattcatttaaaatgactcgttaattaatattaaaattaattcattgaaattaaggaaaacaaggattaatttgtttgtaaattgtacagacccaaaaaatggggaataaacgatggggatgggggtgataggagagaaattaaaagcagatgtaggggaggcaaaagacggatagaagaaagacaaagggcagatggagggaaggtaagaatcaggtggaaggagggcaaaaggaaaatgggcagaagaaaagcagattgcagtcgaaagacaatcagaagacaggcagaacgcagatgaaaggtaatcagaagacaggcagaacgcagatgaaaggtaatcaggaggcaggcagaacgcagtcgaaagacaatcagaaggcaggcagaacgcagatgaaaggcaatcagaaggcagacagaagagggataaacggatggcaggccatccgtttataagactacataggacaggacttctccatatccggaatgaaacccgtctggatttccggcaaggtgactgtaaacgtggtgccgataccttcctcgcttcccaccgtgatatgtcccttgtgcagacggacaatcttatccaccacggtcagtccgataccgttgccctcggtagtgtgggagggatccccctgatagaaacggtcaaatatgtgaagacgcatgtcctggctcatgccgcatccattgtcaatgatctggaatatggtattgccgtcttgctgatgcagctttatcttgatttttcccctgtcaggggagaatttgacggcattgtcaatcaggttgatccagacctggtttaacaggttccggctgccatgatagctgacctcgtccatatcgatgatcagttccagttcttttttctgccatttggattccagcagaaggatggactggcgcacttcctcggtcaggtcaaaccgttccatatcagatagtatgctcatattctcaattttggaaagattcagcacattggccgccagctgggagaggcgggtggattcatggatgatgatatccagatactcgtcccggtcctcctgggacagatccggatttttaagcagttttgcaaacccccgaagggacacgatgggggtcttgaattcatgggagaaattattgatgaagtcagagcgcagaagctcggtattctcaagctcctgggccatggaattaaaactctcggaaagccggacaaattcatgcgtcaaatccagatggacccgcacatggaaattaccgtcggccagctggttaatggcgtctatcagatcccggatgggtcttaagggaatccggctggccaggatggtcaggaccatccccaccagggcgctgaccaggatgatgaatggaatgggacgccagaactggggcatgggtatgtcggcctgataccagattttcaggtacaggtacataagggcgccctggagggtcatgactgcaaacatgatgacaaatatgataagggacaataccagggtgatggttcccagtggtttgtgtttcggcttgtgtttcatatatgtttcaccgccttgtagcccaggccgcgtatggtttcgatggtgaattccggatagtgttcgaaccgtttgcgcagccggttgatatgtacattgatggtattgtcatcggtttccgattcgattccccatatctcatccatgagctggatgcgggtaaatatcttgccgggataggacagtagcttgtacagaagatagaattccttccggggcagtgtctggctgctgccgtccctggtgacggaaagggaatcatagtccaggattacgtttcctatggtgattttccgttcgctggcaatctgcgcccttctcagcagggcgcgtatgcgcaggaccatttcctcctcatccaccggctttgtcatgtagtcgtctgttccggccatgaatcctttgcgtttatcctctggcagcagcttggcggtgaccatgaggatgggcaggttgtaatccatggaacgcagctgtgtggtcagctcgtatccatccatgcccggcatcatgatatccagcacggccaggtcgatgtggtggctgtcaaggagttttaaggcttcctccccgctgctggccggaattgggttgaaaccgttgcttttcaggacagcctccattaattttcttgtattcttatcgtcttcaacgattaaaatctggaacatggcattctcctccatctgaaatctattatacatttatagcatccaaatataaagtgaacatgaataaatcacagaaagttcactttttttattcgtgtacaaccgcttttgttaatgttcaatttatcttcaggttttactatatgagacgaatgcaaaatggtaaaggagagcgacaatggataagaaaatgaaggtaaagataggaatcggagcagccattgcagttgtggcagtccttcttgtgctgtcaggaaagaaaaaaggacagcagggccctgtgggaatggggcaggaggcggcggcaaccatcgtgaaggcgcagaagccgtccgttggggatatcagcctgaccacggggcttaccggaaccgtggaaccctctgacgttgtctatgtatatgccaaggcttctggcgatgtaacaagtgtgctggtaaaagcaggtgacatggtggaacagggccaggtcctgtgtgagattgatacggagcaggtggagactgccaggaattccatggattccgcgtccgtatccctttccgaggcccagagcaatctgagcaggatgcagatattgtacgccagcggcgatttgtcagaccaggagtatgaacagtataccaacaaggtcaagtcagccaggctgcagtatgaatcagccaagctggcctatgacaggcaggtggaatacagcacggtcacggcgcctatcagcggcaagatcgaaagctgcgacatagaggtccatgaccgtgtctcccagtcagcccagctgtgcgttattgcaggggaaggggaaaaacgtgtctccttctacgtgacagaacggatgatggggaatattgccgttggcgacaggctggatatacagaaggatggcacggggtatgaggcatatatcagtgaaatcagttccatggtggattcggataccggcctttttaaggtaaaggcagaactgaaaaatgcagacggcattgccactggcagcaccgtgaagctgaatctggtgactgagcatacggaaaacgcaatgatgattccggtggatgctgtttactacagcggaggggacggatatgtttacctctaccaggatggtgttgcggcgatggtgctggtggaagtagggctttatgatgcggaacacgctgagatactgtcgggactgtccgctgacgatatggttgtcagcacgtggtcttctaatctgtacgagggcgccagggtacagctgaggtcggaagacggtcaggacgatggtgcagatgcccagggccagccaggtgcggatacccagggccagccagggccagacgcccagacggccgcagacaaccgtgcagaatagggaggcatacatatgggacttacaagacttgtactgaaacggccggtagccacggtcatgaccctgctctgccttctggtgttcggcatttcctccgtgttttcagcaaccctggagcagatgccggatacggatacgcccatgctcattgtaatgggaaggtattccggcgcaggacctgaggacatcaatgaactggtgacagaacccatcgaagatgaggtcagcaccttggaaggcgtgaagggcatgtcctcctcgtccagcgacggacggtccatggtcatgctggaatatgactacggcacggatatggatgaggcttacgatgaccttaagaagaagctggataacctggaacgccagctgcctgatgatgtggagacttctgtcatggaaatgaacaacaatgccagcaccaccatgatgctgtccattgcccataagacagagacagacctctacgattacgtggaccagaaaatcgttcctgaatttgagaaaatcacttccgtggcagatgtggaggccatgggaggttcatctgagtacattaagattgaactgcagtcagaaaagatggcgcagtataagctgaccatgaaccagatcaagtcagccatgagcgccgccaacctgtcctacccttccggggacgcggtggcaggcaacctggaactgtccgtgacaacttcggttgagaacgatacattggatgatttaaagcgggtgcccattaccacctccagcgggcagattgtttacatggaggatatagccaacgtatatgaggccgaggaacagaggggaggcatttcccggtataatggccaggagaccatatccctgtccatctccaagcagcagagcagcacggccatggatgtgtcgtccgcggtacagaaaaccattgcctccctggaggcggctgacgaggacctgaagattacggttgcaagggatacggcggacagtatcttaagttccctgcaggatgtggcggtgaccatggttctggcagtcatcatatccatgatcatcattttcatattctttggtgactataaggcatccctgattgttggaagctccattcccacctccatcctgctttcgctgatactcatgaccagtgtgggattttccctgaacgtcattacaatgagcgcactggtattgggcgtcggcatgatggtggataactccattgttgttctggagagctgcttcagggcaacggatgcatgtgaggacaagggattgctggggtatgcaaagtcagcgctgggcggtacgggaatcgtcctccagtccatcataggttctaccattaccacctgtgtggttttcatccctctggtattcttgcagggcatgacgggccagatgtttaaaccgctgggatacaccattgtgttctgtatgacggcatccctgttctcagccatgaccgtggtgccattaagctatatgatgtataagcctaaggaaacggaaaaagcgccaatgtcccgcccggtggtccatctgcagaatgcataccgccgcatcatgccggggctgttaaaacataaggccgtggtcatgctgtcatcggtggccatcattattgccaccctggtactggcaagcggaatggagacagagcttatgacatccgatgacacggggacagtaagcgtatccattgagacaaggccgggaatcctgtcagaacaggcggacgaaatgctgtccagggccgaggcaattgtggctgcggatgaaaatgtggagtcctacatgctgcgctataacagcaacagcggcaccatcaccgcttatctggaagatgacaggaccatggacacggatgaggtggcaagcctgtgggaaaaggaaatggcggatattgacaactgtaccatcacggtagaggcgtccacgtccatgagcttcatgggaaggggcaggggatatgagaccatcctgcgcggaacccagtatgatgagctgaaagaggtaagtgacaggattgtaaaggaaatgacggccaggagcgatgtggcgaatgtccattccagcattgagaatacagcgcctattgtaaccattgaggtggatccggtcatggcggcggcagaggggcttacccctacggaaatcgggagcatggtgagccagatgctggacggcgtggaggtcaccacactggatattgacggacgggaggtcagcgtgatggctgaatatccggaggaggactacaggaccgtggaccaggtgaaaggaatcatcctgaccaagccttccggcggttatgtggcgcttagggatgtggctgagatttatttcaaggacagcccggcgtccatttccaagaccgataaatcctttgagataacaattacggcagattataccgggggaaatgtgaaaacagtgattgacagggaggtcatcaatccgaacctgtcaggcacaatcactaccggggtcaattccagggataagatgatgcaggaagaattctcggcgctttacaaggccattgccattgccgtgttcatggtatttgtggtcatggctgcccagttcgagtcgcccaagttctctttcatggtcatgaccaccataccattcagccttgtgggttccttcgggcttttgaaggtgacgggcgtgaccatcagcatgacttccctgttgggtttcctggtcctggtgggaaccgttgtcaataacggtatcctctatgtggatacggtgaaccagtacaggatgaccatggaccttaagactgccctcattgaggcaggggctaccaggctccgtcccatcctcatgacaagcctgaccaccatcctgtccatgattccaatggcccttgccattggcagcagcggttccacaacccagggacttgcggtggttaatatcggaggcctgacagccggtgtgctggtggcgttgttcatcctcccgatttattatgcggtcatgaatggcaataagaagcgggtggttcttgatatatagaagcacttgatataatagaagtatcggtaaggaaaggtgagtacatgacaggtagaatgaaagcaggatgggggatggctggggagaatgtggcaggaaagagtgtaataggaaagcccgtggcaggtatccttctgtgcatcgcggttgcagcgtcatcgccctccgtttccctggcgggaagcccggaatttgcgtatactgcggagcaatgggcttcctttagggataataaactggaatttgatgagattgcatatctgatccacgaatacaataacacggtcatccagaaccagattgcgtataaggagtacagaggggagacgcgggacgacatttcccaggattattacgatgcggcggatgatgtatacggcgccatggattatcctgactcaagtgattccgactatgccagcaggctgtcctcctatctgaacagccagatccaggtggataagctgagggagcagggcgatgataatgtggatgacggggagattaagaagttaggctacgaccagacggaagccaccctggtaaaacaggcccagacatccatgattaattactggacccaggcctataacctggagagcctgaatgagggcaagacccaggcccagctggcctatgactccacggtcacgaagttcagcgcgggtatgagtacccaggcggatgtgcttacggctaaagagtccgtgtcctcggcagaagcctccatcctgtcagcccggaccagtcttgataagaccagggaggaactgtgtctgatgctgggctggacctatggggcggatgtggagatctgcgatgtgccggaaccggatcttgacggtatcagcgccattgacctggaagcggacgtcacaaaggcgctggagaacaactacagcctgaagatattggagaaacagataaattacgcggtcagcgccaccaacagggaaagcctggaacagtcctataagaaccagaaggaggttgctgcaaacagtgtgaagaccgcgtatcagaacctgatactggcaaaagaggattatgtgcaggcacagcagtcctatgaattagagagcagcaccatggcagccgcggacaggaagcttctcgcaggcaccatgacaagaaatgattaccagaaacagaagtcctcttttacgaccgcagaggtaaatgtccgcacaaagaaactggcgcttctgacagcccaggtcaactatgactgggccgtggacggcctggcgtccgtgtcatgacaggggcaggaatcggaaaggaggcagaaagatgaagggaaaatattggcttctgtcaggtatgctgtccctttccatggctttgtcaggcacattgacggtcctggcagaaggggcggatgcggaatatacgacaaatacagaatatacggcagatatagaatccatggcagatacagaatatacagcagatagggcagatacgggggtatccatggcagcttccgcggtaatacaggaggccgcatccccggaaatgactgtggaatacggcaatctgcgcactcttttgaaagaaggcaacctgacccttaaaaagaccatagaagaccaggaagattccatcaatgcgtatcaggaaatgtgggacaccatgaaatgggaacaggataacctggaagataaggcggaggaaatggaagatgacgcggacagcaagggaatggagacagccgccctttacgcatccaatgcctccatgctgaaatcttctgccaaacgtatctataaccagataaagaacctgacagatgaaaagagcaccagaagcattgagaaatccgcggactcctatacctacacggcccagaccctgatgaattcctacaatcagatggccagcaatgttaaggccacggaaaaaagcgtaaatgccctggaagcttcttaccagtcccttgtcaggaagggccaggcgggaaccgccacacaggcagaggtacaggaagggcagaaccgcctggaacaggcccgcacatccctggcctcccttaaggaacaggaaaagcagctgcggtttaagctgcttaacatgctggggctggaggacagtgaatctgtatccatcggagccatacctgagccggacctgtccgccatcggggccattgactttgagggcgataagagtaaggccattggcaatgattccaatgtccagagccagcgccattcaaaggccgtcagcacagcggagattaaccagaggttcaggcaggtggatgaggcggagggaaccgctgaagcctccattaccgccgcctaccaggaactccaggcacagcttttacagtaccaggcagcgctggaatcctatacaggcgcggaacttgtttaccagtcccaaaagcgcaggcaggcggcaggtatgctgtccaatacggaatatctccagggagaggcggactatgccaaaagtaaggctgcaaaagagactgcttccatgaacctggtccaggcgtatgaatcttattgctgggaggtgaaggggattagctgacgggggactgcagcaggccacatcacacctgctccagcgaatccgtaatatgccgcgccggtatccgcacggtgacctcggtccccctgcccagcgtgctggtaaaggaaaggccgtacatttccccatacaggcttttgagcctgaggttcgtgttataaatcccgatatgcccgggggaagcctgctgctttaccccggcgtccatatccgcatgccccatatcgtgcatcagggtatccagtttttcaggcggtatgcctgccccgtcgtcagagatgatgaattcgatatcatcccctgacttccatccggtgagcaggatgctgccttttttctgttccgttgtcatgatgccgtgtaagaatgcattttccacaatgggctggaaggtaagcttggggatggtgtaatcgtaaagctcatccggcacatccatcacaaaggtgacgcagttgtcatagcgcatgttctgcaggctgatataaaggctcacatgctggagttctgtctcgatggagttcataagcccgttgcggcttaaggtcagcttgtagaaacgggacagggcctggatggcccgtgttacctcctggttcctcccggtctgggacagccagtttatcatgtccagggtattatagaggaaatgcggattgatctgggcctgcagggcgcggaattcagcgcgccgcagattgtccgcggcatccttctggctgtccatgagcaggccgatttcctctgtcatgtagttgtaggtgtcggccagcacgccgatctcgtcacagcctgtgtcaccgatgtctaagggctggggccgtccggtgcggaccttttccatctgcagggcaacggtaatgatacggtctgctatggagccggacagctgaaaggagatgtacatggcaatcgccgtaaagaaaaggtagatcagcgcaaagtgtgtcatcatgtcccggccagcgtccgtgatatggagggcgggaatcacggaaaccatgatccagtccgtgtccttgattggaaaataggccgcgtaagcagagctgtccataaatgaaaccagggaaaactccttttccatgcccatgcgtgagttgaattcggaatggggcatatagtacatcccggccagcgccatgtctgatgcagagacaatcacatccctgctgttgatgatgaacgcggcctcgtccatgaccgtcgcgtccttgctgagcacattatcaaaggaagtcctggaaaaatagactgcgatataggcagaagcgcttctggaactgtcaatggcaggttcgctgtccgaatatggaatgcgcgtgatatatgcaaggcgcccattcttttccgcctcggtgggggacaggtacagttcagggcaaagcagggaagtactgtgggaggtgctgtaaatcccgtaccagtagctgctggatattgtggacatgggcaggaacagggcgttattgatctggttgtactgctgcaggtcaccgtacgcctggtcatcatagtatattttcacatctgtgatcagggaggtgtctgtcatgctgcgggccagatggaagaggctgttcatcctggaggtagaaatcgtcttatcctttgcatcctctatggggatacggaacacgtcctgtacaaacagggagttggttatggtatcagaggatgaggacacatgggatatcaggttctcaagggaattgacggtctgggcggacagcacctgctcagagcgtatgctgtccttcatgacaatatcataaatgcgcaggaaaaagaagcctgacagcactgcggtgggcagcaggatcaggacgatatgggatatgaccagtttcgtcttcagccgcatatcatacgtatagcggtggatcagctgttggattggatttttcatcagagcatcttctccctgtattcagaaggggacagccccacgatttttttaaatgccttgctgtaataattgccgtcgctgtatcccaccttggaggatatgtccgctatcttatagcgggggtcgcttaagaactgcttggacatcttgatcctgtaatccgtcaggtactggtttaaggtctggcctgtctcatttttaaataccgtacacacatagctgggtgacagatggacgtgttcgcttacatccgggacggatagggagggcgcggcgtaattctgctggatgaattccttaatctggaacaccacgggattctcgccctggctgtcctccagctgttcaaagaactgcctgatcttggcacacagcaggtcatgaagttccttcagggtagcgcaccccatgacgccctcccagatgctttccgtattaagtccttctttctgccacagggaaatgtagttgttcatgccgtgttcatccagcttgcttaaatacttataatagatatccttgacctggctgggacccagcacgtcattgggcacaaacgactggtaaagctgtcctgccagtttaagggcctggtcctcctgcttttcggccagggccatggagaattccagcagcacgtcggccgggggatggaagggggcattggccgtgtccttgtccaggatgaaaccatattcatggaagaagctttcttttaaatgctcctttgcttccatataggagatgtgtgcccgctccacgccgctgaccaccgggcctacggaaacgaagaaacgggagatttcattcagctgtttggacaggaaggcggcgcagtcgtgaatcagcttctcctcctgcctggcatcggaatacaggaaaatgatgatatagcggtccgcccgtatgaaatacatctgtcctatccccttgtccgccagcatgctgctgaatgaatccctgacctcgtccatcctgttctcaggaagcagggtgacgggggtctggctgtccagcagcagggcgctgaaacaggtggaggaattgatgggaagcccaagactcccaatcagttcaccggcctcatcaaggctttccggctccggttcggtcagcaggagggtgagatggcccagctgttccttttcgtggcttctggacgcggccaggtgggtgctcatggtcctgcgtgtttccacggcctcgcccaaagcctgtttcagctcttccatatccaggggtttttccacataacttacggccttcagcttgatggctgctttcagatattccttatctgagtaagcgctcatgaaaatgatgacagtacctggattggcggccaggatctgctccgccatctggacgccgttcatccgcggcatccgtatatccgtaagcacgatgtcgggcgattccttcagggctgtttcaaggccgtggacaccgtcatcagccaggaacactccggatatccccagaccctgtaaatccaggcggtcccgtatgccttccctggtcagcttctcatcatcagcaattagtagtttcatctatatcaacgtccctttctgtcggtaaacccataatgatggcttatatcattattttaacaagaattcgataatttgcaatgaaaatagacaaaatcccctgttaggtatatactggaaaaagaaattcattgaaggcggtgggaagatgaaaggcaggcatggtgcatggatacttgctgtgatactgatgatagcagggattttcataagttcctgttatggacagcagcttcatgacaaggggacctacgccattatcatgaagtccagggacaactggtataacgagctggccagccagggataccgccgtgtcatagaggatgcgggcaagaactgcatcaccctgtatccggatgaggccacggcacaggaacaggtccggctgatccgcaacctgatccacgagcaggtggatgccattgcggtggctgccaatgatgaagatgctctggcgccggtcctccgggaggccagggaaaaggggatatccgtgattaccctggacgcggacgtcaaggcggacagcaggagcatttacattaaaccggtggacgcagaaaagctggggcgtgccctggtacgttccgcctgtgacatatgcagcggcagcggccagtggtgcatcctttccgcgggcagccgttccgccaaccagaatgagtggatgtactggatgaaaaaggaactggaggagtccggatataaggacatgcgcctggtggacattgcttttggggaaggcgtgtacgataaggctgtaaaggagacggaacgcctgttaaagaactacccggaggtgaaagtcatctgcagcctgtccacggagggaatcaaggctgccgcggatgtggtaaaaaagcagggaaaagaaaagacggtgaaggtaataggcctgggcctgcccagccagatggcggaatacattggggacggggaagaggatatatgccctgtgatgtacatatgggacccggtggagatgggaaaggtggcgggcttcgtgtccatggggctgtggtccgggaacatagaagaacagccggggaaggatatccttctggataatggcgccgcatacaggataagcacgggatatgacggcggtctggaaatcatatccggggagccaatccgtatcgataaggacaatattgggtactgggaaacgcggttataggaaaagaaaggacaattttacgccatttaaaaagatattaccatagaattgcaatggtctgcgtgctatgataagagcgtaaagaaaaagaacggtatacagatgaagaattcgaaatatactatacggaggtgaataaagatgaaacatatacttgtaaaatttgaccaggcagaccagatcattaatttcgtccggatcatcaaccgctattcatatgatgcagatgtaaaatgcggcagccgtgtggtcgatgccaaatcagtggtcggggtgttatccctggcaaagtccaaaacagttgagctgatccttcacacagatgaatgtgacgggcttctggaagaaatcgctccttatgcagcgtgattgaacatgaattcccatacttaaaatacaggaaccggccggttgcaggatatgcaccggccggttcctttttccctggattatcctgcttttctatattttaccatccctttacgaaagttttataaaacaatggtatcgctccttctggcaggatgtgacaatggacaggaacctgcccgcaatcctttgtacggaaaaaagtacaaagggctgcagggtctttgatccggacaggaaaaatggcacttgggtacgggcgcaggacggatgctgggatcctgtagaaaaagtaccgggcagataattgggggttcggaaacagaatcccggaaagaaggggagaaatggcaaaaccattggaatatgagataaaaagaatatatgccagcctgcgcaaatccgaacaaaaggcagcggactattacctggggtatgacggaccggtggagacaatgtccattgcggccatggccagggcggccggggtcagccagcccaccgtgatgcggttcgtgaaagctctgggactggaaggctttaaggaattcaagtaccaggtcctgaaggcgtccctgggcggtaatggcagtgggatgggagaggaggaaggcgggcgttcagaggaggtcctgcggtatggctatgagatatccgcccgggaccggccggaggaagttcccgggcgcgtggtggcccagtccgtgtcttatctggatgatgcgttaaaacatatatccccgtcatccatcggcagggcggcaaaactcatctgcggcgccaggcagattgccgtctactacgtggagaattcggcctctgttgcaggggacctggtcacaaagcttatgtatctggggtttaactgcatcatgtacaacgatatctatctccagcatataagcgccggcaatctggacagccgggatgttgcaatcggcatatcctattccggttcatctaagaatacggtggacgtgatgaagctggcgaaaaagaagggggctgccaccattgccatcacgaattttgaacattcgctgattgcgggccatgcggatatactgctgtgtaccagcagccagcagctcctgtatggcaatgccatattttcccgcatgtcccagactgccgtggtagacatgatttacatgggtatcatcctcagggactatggacattttacaggaaagctggatgagagcagccggatcatacgcaggcatgcatactgagggcagccggatcatacgcaggcaggcgtactgagggcagccaggtcatacgcaggcataccggggcgtgcttggcaattcattcccgccgtattagaaagaaggttttgtagaaatactacaagccttctttttttccattttgtggctttaccctccctttacaaaggacttacatggatcttgttgtattcggccggacggttgtgctttaatgtgggtgtttagaaaaacggtctgggcagattaaaaggagggcatttatgctggaattaaaacatatcaggaaatcatttgacggggtaaccatattggaggacatcaacctgacaatcggggacggggaaatcgtatccatcctgggtccgtcgggatgcgggaaaaccaccctgctgaacctgattcttggaatcacggacgcggacagcgggcagatgctgttccagggacaggacatcacccgggttcccatggaggagaggggatttaacattgtattccaggattatgcgctgttccccaacctcaatgtatataagaacattacatacgggcttaagaaccggccggggatttccacgaaccaggaggtggaggaattcattgaccttttgggactcagggaacatctgtgcaaacggattgaccagctctccggcgggcagaagcagagggtggcgctggccaggaccatggtcatgaagcccaggatcctgctgctggacgaacccttaagcgccctggacggggtaatcaaggaatccattaaagaaaaaatcaaggagattgccagggaattcaaactgaccacggtgattgtgacacatgacccggaggaagccctgaccctttccgacaaggtgatgattgtgaatcagggaggcattgcacagtttggcaggccggaggagattataggcgcgccagcggacggctttgtggaggaattcatcttaaaccagctggagataaaaaagaacaacattttctccctgttccagagggaactggctgaccgcgtgatcatgcaggcgggctgaccgggaaatgatgggagattttacaatgaagacgatgaaagagagagaaatcaagggcatttacgcgctggtcaccggtgttttcctggtattcctgctggttcccatcctgcttcttttggggaaatcctttgagtgccagggaggcattgccctgtcgcattatgcggatgtgcttaccgggaagggatttgcgggagcatttgcaaggagcgcggttgtggcctccctcagcgcggccgtgaccacggtcctggcattcatcctttcctataccatccattacaccaatgtgcccagagggcttaaggggttcatacgcctggcggccgtgattcccatgctgctgcccaccatcacatatggattcgcaatcatctattcctttgggaaacaggggcttctgaccaggctgttgggaaggcagctctttgacatatacggcttctggggactgcttttggggtatgtgatctacacccttcctgtttccttcatgctgatattcaattccatgagttttattgataaaaagttcatgattgtatccaggatcatgggggacagcccgttttccacctttcttggaaccgtgctcaggccgcttcttggaaccctggcagcttcgtttgtacagtgctttttcctctgcttcacggattacggcatcccggcgtccgtgggagggcagtatgacgtggtggcttcggtgctgtacaatgaaatgctgggaagcgtgccggatttcaaccgcggggccgtggtggccatgtccatgctggtgccgtccgttgtgagcatttccctgctccattacctggagcgctataatatccggtacagccggatttccaatactgaaatccgcaggggcaggctccgggatgtgttctgcggcgcggcgtcctgcgccatcctgacttgcgtcctgtgcgtgtttgccgtcatattcgtggtgcccatggtgcaggaatggccctatcagatggatcttacattcagccatgtatgggatgtgttccgggattcctccctgtcagcagtgtacaggaactccatcctggttgcggtgctgaccgccctgaccggctcgctgattgtttacggggcagcccttgcaacggccagaagcagcctggatcaaaggctgaaggacatcatagaaagcattgccctggtgacaaacaccataccaggcatggtaatcggcattgcattcctgttcaccttttccggcaccccggtgcagaatacgtttttcctcctggtcatctgtaatgtggtgcattttttctccacgccatacctgatgatgaagagctcccttgcgaaaatgaacgcatcctgggagacaaccgccctgctcatgggggatacctggtttaagactatcctgcgggtggtcacgcccaacgcggtgtccaccctgctggaggtattcagctattattttgtcaatgcaatggtgacggtcagcgccgtcattttcatcgcaggcgccaggaccatggtcatcacgacgaaaataaaggaactgcagtattatacaaaattcaatgagatatttgtgctctccctcctgatcatggccacgaaccttggggccaaggcgttgtttggcgctttatcaggaagaagggaaaatataaaaatgaaaagaggaaagtttatgaaaaagtggaaaaaagcagcaaccctgggaatgactgcattgattgcagcgtcagccctcacattaaccggctgttccgggaaggaatcacaggtggtaatctactccaatgcggatgatgaggccatagaagccatgaaacatgccctggacggcaatggatttgaaggaaaataccttctccagtcctttgggacctctgaacttggcggcaagctgctggcagaggggaccaacatagaggcggacgtggtcaccatgagctccttttacctggaaagcgcccaggaccagaaccatatgttcgcggaccttgcctttgatgccggggcaatggaggaatacccctcttactacacgcccattacgaagcaggagggcgcaatcattgtcaacaccgagatgatgaaggaaaataacctggccatgcccgtctgtttaaaggatctgtcaaagccggagtatgagggctttgtatcagtgacggatatcaaaagttcatccaccgcatggctgctgatgcaggcccttatcagtgaatacggtgaggacggcgccagggaagtgcttaccgggatttataaaaatgccggaccccatgtggaaagctccggatcggctccccttaagaaggtgcgcgcaggggaggtggccattggattcggcctgcgccatcaggccgtggcagataaggcccagggactgccggtagactatgtggatcccctggaagggaacttctccctgactgaatccgtggcagtgattgataaaggcggtaagactagcccaatggcccagaagatggctgagtgcatcattaaaaacggaagggcggagctgattaagacatatcccctgccggtttatgaaggggagcaggggaatcctgccaatatgtccgcctatccaaaggtatttccccaaaagctgacagtggacctgctgaaacagcatcaggacctttcagaaagctgtaaataaaccacaaacaagaagaaagaggagtaaacggatatgatgaattataagctgctgacaccggggcctttaacgaccacggataccgtgaagaaagagatgctgtttgaccactgcacctgggatgatgattataaggaaatcacacaggaaatccgcaggaaacttcttgggctggcccatgtcggggagcctgaatatacatgcgtactgatgcagggcagcgggacctttggggtggagtccgtcctcacaagctccgccgggccggaggactgcctgctcattgcctccaacggcgcctacggggaccggatggcggatattgcaaagcacgcaggaatcccgttcatccagtactgtgaggagtatgaccgggtgccctgtgcggaccggatccgtgagctcattcagaagaacccggaaatcacccatgtctccatggtgcacagcgagacaacatccgggattttaaacgatatcgcatctgtggcaaaggtggtgaaggaagcggggcgtgtctttatcgtggacgccatgagcagcttcggcggcgtggatataccggtcggggatttagggattgattacatcatcagcagcgccaacaaatgcatccagggtgtgccgggattttccttcatcatctgccgccgggatgaacttatgaaatgcaacgggaaggcgccaagcctgtccctggacctgtacagtcagtgggagaccatggaaaaggacgggaaatggagattcacctcccccacccatacggtgctggcctttgcacaggcgctcagggaaatggaggaagaaggcgggattgaggccaggagcagacggtatgccggcaataacaggctgctgattaaaaagctggcggaacttgggatccgtccatatattgaaggggaatatcaggggcccatcatcaccacttttttctacccggaggacagcagcttttcctttgaggaaatgtaccgttacataaaggaacggggatatgccatctatcctggcaaggtgacggacgcggataccttccggattggtaatatcggggagatttatgaggatgatatcataaagctttacggtataataaaagagttcctggaggataaggaaaaccaggaaaatgacagggaggaacagtaaaatggcattatttgacgcagttattcttgactgggcaggcaccaccgtggattacgggtgctttgccccggtacaggcctttgcggaggcatttggggaatacggcatccagcccaccatggacgagatacgggggcccatgggcatgctgaaacgcgaccatgtgcggaccatgctggagatggagcggatttccggggaatgggaaagaatccacggccgggcgtttacccaggaggatgtggaacaggtctatcttctcagcgaaagtaagatccttggcctggcaggcggattcaccgatgtgaagccgtatgtgacagaaaccgtggaaacgctgcgcggccacggaatccggatcggctccactaccggatatacggatgcaatgatgggcatcgtggcgcctgccgctgcgcagaagggctacagcccggactgctggttcagcccggattccacgggacacaaagggaggccgtacccatatatgattttccgcaacatggaggccctggggctatccgatgtcaggcgggtcatgaaagtgggggatacggtttctgatataaaagaaggaaaaaacgcaggtgtttatacggtgggcatcgtggagggaagctctgccatgggcctgtccatggaggaatatgaggccctttccccggaggacagggaatatgcctgcaagaccgtgagccggaagttcctggaggcaggggctgactgggtggtcagggatatacggggggtcctggaacttatataagttccggctgtcagctgcatctgcgtgtcaggggtgtcggctgcagctgttttccagggctgtcagttacatgtgccggtttcatggttccccggcattgaagtattcctttcttttggctataatattaagtagttatggttggaaaggcaacaaaggaaaggagatgccctatggctattattgcaggaatcatggtaccccacccgccccttatcatacccgatgtgggacggggccagcaggtacggataaaggatacggtggaggcatatcaccaggcggccagactggccgcggcctcaaagccggacaccattgtggtgctgtcgccccatgccgtgatgtatgcggactatttccacatttccccgggaacaggggcaaagggtgacttcggccagttcctggctccccaggaagcagtggaagtggaatatgacactgaatttgtaaatgaactctgtgacctggcggatgatattgattttcccatgggcaaggaaggggagagggacagggagctggaccatggaaccatggttcccttatacttcatcaaccagtattaccatgattaccgtctggtgcggattggcggttccggccttccctttacagaccattacagggccggacagttgattgcacaggcggtaaagcgcctgggcaggaggacggtcatcattgccagcggcgatctttcccacaagctgaaagaggacggcccttatggtttcagcgtccaagggccggaatacgataagcgcatcatggacgtgatgggcatgggcaggtttggagggctgttggatttcacggaagggttctgcgaaaaggcgggcgaatgcggacacagaagctttaccatgatggcgggcgccatggacggtatggcggtaaaaccgcagcgcctgtcctatgagggtccctttggggtaggatatggtatctgtacctttgaagtacaggggaaggatgagggccgctgtttcctgaaggcatatgaggagcgggaacaggccgtgtgcaggcagaagcaggaagcggaagacgcctacgtatccctggcaagaaagtccctggaacattacgtgcataccagaaggatgataccggtccaggcagtggaggaaggcctgcccggcgaaatgttaaaatcacgcgcaggcgtctttgtctccatccataagaacggtgcgctgaggggctgtatcggcaccatcgcgcctgtgtgcgggaatgtggctgaggaaatcatccagaacgcggtaagcgctggcatccatgaccccaggttcccgtccgtcagggaggatgaactgcagcagctggtatacagcgtggatgtgctgggggagacatcgcccataagcgggcctgaggaactggatgtgaagcgttacggggtcattgtgacaaagggacgcaaaagagggcttctgctgccaaacctggacggagtggacacggtaggggagcagatcggcattgccaggcagaaggccgggattgggccggatgaggacggggtcggtctggagcgctttgaagtcataaggcatggtgataagggatgaggatgacatgtgatgtatgcatgcaccggtgcagcctggaaaacgggcagaccggtatctgccgggccagagggaaccggggcaatgggattgtccccctgaattatggcaggcttacatccatggccctggatccgattgagaaaaagcccctgcgcatgttctgtcccggaagccggatcctgtccgtgggaagttttggctgcaatttaaaatgtcccttctgccagaaccacgggatatccatggccggggaaagggacagtgaggtggtgacggtgacgccggggcagctggcggacagggccgcggacctcagggacaggggaaacatcggcgtggcctacacgtacaatgagccgctggtgggatgggagtttgtccgggatacggcccgccttgtcaggatggcaggcatgaaaaatgtaatcgtgaccaatggcagtgcatcggaccgggtgctggacggactgctgccctatacagatgccatgaacatcgacctgaaaggatttacggaccgctattacaaaaaactgggaggcagcctggaggtggtgaagcatttcatagaacgcgcggcaggagaatgccacgtggagctgacaacactgattgtgccgggggaaaatgattcagaggcagagataaaggaacttgccgcatgggttgcgtcggttaatccgcggattcccctgcatataaccagattctttccgatgtggaagatgacggaccgggatgcaacggatataggctgtctgtatgcgctggtggaggcggcacgcggccgcctggagtatgtgtttgcggggaattgctagggcgtgtttgaaaattgctttccgtcagctgtgcgttccactttgtgggagatttggtcccgatgagggaggcgtagcgggctacgttgaccgaattgggaccaaatatgccgcgaagtggggcctgcagacggcgggaatgaattttcaaacacgttctaggcgtgcagataccggtaatggattttctgtcagggtcaggctcttctcacagcaggtgtccaggaaaaatggatttttcaacaaatattagcaaggattctcccatcctctaaggtggtgagatgaattgccaaaaacaaacttaacggcagtggtgggcggagagtaatcggtatcccccactgccatgaggtcaaccacgcatctacgtaggatgcagtcgcacttcgacaatataccgggcgtggattgaaacaataggttcggataccccttgccacggatgcgcatataatgatagtaacggatgcaaatgcactgccgcctgaagcccggcagtgcatttgctgtatgccacaagggggagagtatgatgtattacaatcaaatggatggatgtaactttggtgctcaggatgacttagggccccgggaatgtgattgctgctgttgccgcggcccggcagggcctatgggtcctcaggggatacctgggccggaagggcggcaaggggcaacaggccccacaggcccacagggcatccccgggccggaaggacggcagggggaaacaggccccacaggcccacagggcatccccgggccggaagggcggcagggggaaacaggccccacaggcccacagggcatccccgggccggaaggacggcagggggaaacaggtcccacaggtccacagggcatccccgggccggaagggcggcagggagaaacaggccctacaggtcccatggggcttcagggagtaaccggaccccgcggggcaacaggggacactggaccacagggggcaacaggtgaggatggtccacggggaaatacaggagccactggccctcagggagaagctggcccaaccggaccagccgggccccaaggccccatgggtccccagggggaccctggcccggaaggcgtacaggggctgcggggtgccaccggtcctcaggggccagccggcccccagggagatgcagggaatacaggggctgccggaatacagggcccaaccggcccaaccgggctgcagggacccactggccccatgggtccgactggcccgaccgaaccatatcccgatgacatatttgcctcattcattaattttgccgctcacttcgtcaatgcgtcgctgatgcccatgggaatcggggtggaggatgtgaccaaccacattgtgttgacggatccgacccatataacgctggaacctgggttctattccatcttttatgaagtgtcggtattgtatccggggaccacgttcatgcagattactccgttctataacggcagtgcccatattgaatacgggatttatttcatgacgggcccggaccgctccagcgccttcgggtcggtgtcgttcatcattgaggtgccgcagcccacggtgttcacgcttacctacaacagcccggtggacggaacggaaggcaccctgaccatggtaatcaggaagctgcgcagagaaacttaaattgacttttaaaacaggccgtagtatactgtagcaagaaaacaaagaggggtgctggtctgcaatccataccggctgagatggaacttcggtttccgaaccctgatacctgatctggataatgccagcgtaggaagtgctcagaccatgtctgttatatcccgcccggattgtccgggcgggatttttatgaccggcaccacgaataaaagacgaagaggagaggtatccatgaacgcaagcgtagctattcagacattaccggaggcagggaacaacgaggagttaatccgtattgtggatgaggtgattgattacattaaaagcacggggttaaactactatgtaggaccttttgagacggccattgaaggggattatgaccagctcatggacattgtaaaggaatgccagcacattgcaatcagggcaggcgcaccttccgttgccgcctacatcaaagtatcctaccatcctgaaggagatgtgcttaccattgaaaagaaagttacaaaacatcaccagtaagatatggtcgttttcagcagcggcatgcatcctggctgtgtggcaggcagcggtatccctcggctgcattgagggcttcatgctgccttcccccgtccaggtcctgaggacttttataagcgagtttcccatacttatggacaatgccgggataaccatggcggaagcagccctggggctgctgtttggaattgccacgggttttgccgcggctgtgttcatggaccgctttgagcgggcgtatcaggcattttatcccatcgtggtcctgacccagaccgtaccggccgtggccatggccccgcttctggtgctttggtttggctatgagatgacgcctaaggtcatattgattgtcattaccacatttttcccaattacggtggggctgctcaccggatttaagtccgctgacccggatgcggtgaacctgctgcgggccatgggggcggggaggatgcagatattccgttaccttaagctgccgggagccatgaaccagttcttttccagccttaagatatcggcaagctatgcagtggtaggggcggtcatatcagagtggcttggcggttttggcggactgggcgtgtatatgacaagggtaaggaaggcgttttcatttgacaagatgtttgcggtcatcttccttatatcggtcatcagcctgctgcttatgcgggcagtggaactgctccagaagaaatgcatgccatgggacaacggcgccaaggacagatgatcatgccatgggataacggcgccaggtacagatgatcatgccatgggacaggaggcctggacgggacaggcaggaggaggaacagatgaaaaaaacatatacagtgattctggcagcggcattgcttggaattgccctgaccgggtgcgcgggagcatccggcgggagcagtcaggcggcgggtgaccggaaggaacagtcccttaaggagattacctttgtactggactggacgcccaataccaaccacacaggcttatatgtggcccaggaaaaaggatattttaaggatgccgggcttaatgtgaccatggtgcagcccccggaaaatggcgcggaggtgctggccgcgtccggcaaggcgcagtttgccatgtcctttcaggacagcctggcgcctgcgttttcaggcgaaaacaagcttccggtgacagcggttgcggcggtcatccagcacaacacatccggcatcatttcccggaagggggaggggatggacaggcccaggggactggaaggcagacagtatgccacctgggaccttcccattgaaaaggccactatccgggaggttgtggaagcggacggcggggattttgataaggttaagctgattcccagcatggttacggatgaggtgactgcccttaagacaaaatcagtggacgccatctggatcttttatggctgggccggggtgaagacggagctggaaggactggaaaccgattattttgcatttgcagacgtggatcctgtatttgatttttacaccccggtcatcattgctaataatgatttcctggaaaatgaacccgacacggcaaaggcgtttatggaagcagtgagccgggggtatatggatgcggccagggacccgcaggcggcggcggatatcctctgcaaggcggcgcctgagctggacccggaacttataaaggcaagccagatttacctggctgataagtatcaggcagatgcagcgcagtggggatacatttccccggaacgctggaacgcatattatgactggctgtccaggaatgggctgacggaaacgccgattgaggaaaatacaggcttttccaatgaatatctgccaaaggacggatgacgggaacggatttttagacacggcctgatccggatagagggaaggcgtggcaaagggacgggaggaatacatggcacagctgaaggttgagggggtatccaaatcctttgacggggaaccggtcatccgggatatctccattgaactgcacaagggggaactggtatcgctgttaggcatcagcggtggcggtaagaccaccctgttcaacatcattgcaggcttaagcaccccggatgaggggcgggtggtgatggaaggggaggatataacaggatgcccggggcgggtaagctatatgctccagaaggacctgctcttccccttcaggaccattgaggataacgtggcccttcccctgattatcaagggcgtgaagaaaaaggaggccagacagcaggcaggggagtattttgcaggattcggcctggagggaacccagaagaagtatccggcccagctctcaggcgggatgcgccagagggcggcgcttcttaggacctatcttttttccggcagcgtggcgctgttggatgagcccttctccgccctggacatgcttaccaaacagtcggtccacaactggtatctggacgtgatggagcagatccgcctttccaccctgttcattacccatgacattgacgaggcagtgctcctgtctgaccggatatacctgctgacaggaaagccgggcaccataaccggggaaatcgtggtgaaggagccgaaaccaagggcaagggattttcaggtgacggacgtgttcctggattataaaaagaccatattgaaccatctgaagaagtactcggatgaagtatgacataaaaggattcccatcagtaatggccgggaatcctttttccgtactggagcgtgtttgaaaattcattcccgccgtctgccctaaggaatccaccagaggtacccccttaggaccaagcacgccccacttcgcggtatatttggccccgattcagtcagcgtagcccgctacgcctccatcatcgggaccaaatctcccacaaagtgggacgcacagccgacggaaagcaattatcaaacgcgctccaggggcctgaaagaagattctctggttgacggggatgctgaaaaaagaatataatggtaccataagtgttagggaatgaattttcaaacacgccctggcagattagggaaaagaggttgtgcatgaacacggtgaaaagcagcaacgaaaccagtatttatattattgatgacaattaccggattgtacattttaattcaacccttcgggataagttcccggaactgcagtgcggtgacatatgttatgagaagctgtgccaggaagtgaggccatgcgcacgctgtccctttaaccaggagggtgacgaggcggtggtattctataataaggtggtccagaagtggctggaggtagggactggccggattgagtggcctggaaagggcacatgcaacatggtcctggtgcgcgagatccgtgaggggaataagaacctgttttacagcctgaccaatatatctgcatatgacgagctgtatgagctgaatctaaccagggacagctaccgtcttctgtatcatgtggaggacaagtatgtaatccacggcatggaaggaaagcttagccggatgcttgaggaagtggcggggcacatggtccatccggatgatgctggttccttccgggaattctggaacagggatacaatcagtgaatgcctgaagcatgagggggataacgcggcgctcaagggacagttcaggaggctgcgcctgaatggcgcctatacctgggtgtcccagattgtggtaccccttaagcgcggttccaatgatgatgagaccgtgatgtgctttatccaggatatcagcgaacagaaatccagggaagatgagataaagaggatgctggcctcaagggacggggagtttgaccatctgaccggactgcttagaaggaccgtgttccttaagcgcgcccaggaattcctttccaaaaagaacgggtcatactgtctggcagcggttgatatagagcatttcaagctgtttaatgaatggtacggacaggaggaaggggacaggcttctggccaggattggcggccatcttaaggatattgagacttcatacaacgggattgcaggatatatgggaggggatgattttgtcatcatcatcccggatgacagggaagccatcggggaactgcagaaccggatcatgacgtatgtaaggcagagcgggggaacggccggtttcctgcctgcctttggaatctatggtattgaggacggatccctgtccatcagcaccatgtacgacagggcgtgcatagccctggcatcggtgaagggaagctacgccaggaggctgtgccggtatgacagccgtatgatgcgggagatggaggaaaaccataagctgctgtccgaggtgcagaaggggctggaccatggggaattcttattttacgcacagcccaagtgtaacctgagtacgggcaagatcgtggggctggaagcccttgtgcgctggaaccatccggtcagggggctgatccctcccggcgtattcctcccgcttttagagaataacggcctgattaccaagctggacctgttcatctgggaagaggtctgccggaaactgcgcagatggattgacaggggacaccgtccggtccccatatcggtcaatgtttccaggatggatatctatgcagtggatgtggccgctgtgtttaaggagctggcagacagatatgccattgaaccgcgtctgttggaagtggagattacagaaagcgcttatgtggaagagtataatgtcattaccggcgtggtggaatcactgcgggaggctggttttactgtcctgatggatgactttggaagcggttattcctcccttaacatgctgaaggatgtcaatgtggacgtgctcaagattgacatgaaattccttgagatggatggcaggtccatgggcaagggcgtggaaatcctggaggcagtcacaaggctggccaatatcatggggctgcgcataatcgcggaagggattgagacaaaagagcagattgatttcctgatgaacatgggatgcacctatggacaggggtattatttcttccatcccatgcccatagaggtattcgaaccccttctggcggatgaggataacatagacttccggggaatcagggcaaaacagattgaacgtgtaaggcttaaggacatgctggaagaggatattgccagcgatgccatgatgaataacatactgggcgctgttgcattctacgaggtatatgacgggcagctggagctgctgcgggtaaatgaacagtactgcgcgcttacaggcaccaacgcagtggaactggaggaacagaggaaatccatccttaaggataccagggaagaggacagggagtctgcttttggcatatttacccaggcatatgataatccgctgaaaggggcggaaggggacctgcgccgcagaagaggggacggcacctatatgtggatgcatctgcgcgtgttcttcctcagggagcaggatggacggaagctgttttacggcgcggtgtccgatattacggagcagcggcgccgggaacagatgctggaggcctcccagagggccttatctgccgtggtccacatctctgagaaggatgagtccttcatgcagctggcagaggataaccgccgtgtggcagcgtccatatttgcacagatgacgccaggcggcatgattggcggatactgtgaggatggattcccgctgtattttgccaaccatgagatggtacggcttctgggctatgagacatttgatgaactggcggaagcaattgattatcaggtggtcaataccatccatcccgatgaccggatgcgggtggggaaggatatcggaccggaatattacgcagggctggagtataccaccacctacaggatgccaaaaaaggacgggacctggttctggaccctggataagggccgtgtaatcgaggcagaggacgggaggcttgcgattgtcagcgcgtgtacggatatctctgagaccatggaggcccagcgtctcctgctggagagcaacagcagcctgaaacagaggaatggggaactgaatttccttaacaacgacatgccggggggataccaccgctgtgccaagaacagtgattttgatttcacatacataagcaaccgtttcctggaaatattcggatataccagggagcagattaaggaactgtttgatgacaaattcataaatatggtgcatccggatgacagggacaaggtgcaaagaggggtgaacttccttaccagcagcgaaaaaccctataatatggagtaccggatgaaggcagccaggggatatatctgggtcattgaccaaagcaggcacatgatgtatgagggaaatgaattcttccagggagtggtcctggatgtgacggagctggtaaccctgcgggagcgtcttcagctgcttctggcccatgtgccggaggattttgtccttgtcagctgccatgacggaaggtttgaacatgaaatcattgctgacgggctggcacggaccatgggctattccagggaagggtatctggaacttttaaaggacggaggatatctgaagggacagacgggccatggatttgaaaccctgctccgcgaaatcagggaaatgtcggaaaagggcggaagctttgtacatatatcaccgttcctgtgcaggggcggcaggcgtatgtggatcaggacagaggccatgtccgtggagcgtacggtcaatgaaaccatttacctgtttaattacaaggatgtgaccggtatacaggagaaaaggatggagctggaccttctgggacggaaacaggaatccatcctcaggctggctgatattaacagctgggagtggaatctcagacaggataccctggtactgaccaatgtgacggattcaaacttcatgaagtatttctgcagcaggagaagggaggctgggaacgtcatacgcggcctgtcccaatgcctggaaaccctgacatgcattcccggtgaatacaggcaggcgttacaagccttcaatgaaaagcttcgcacggaccggagcggggagacccttgtttttgaattccctgtggctgcaaaggacgattccatggtgtggttcaggacagcggcccagacgctggtggatgaagacaataccccggtggtcgtggtgggatataccacggatattaccgagaccaggctgcaaagccagatgctgacaaggatggcctccacagaccccctgaccgggcttttaaaccgccagtccgccataccggccatacaggcttacctggcccagggaacacggaatccatcatccctgatcatgtttgacctggataattttaagctggccaatgatgtgtttggacacgatttcggggataccatgattgtccagaatgcaagaaagctgaaaagttatttccgcagcgatgacatcgtatgccgtattggaggggatgagttcatcgtcctgtgcaagaatatcagcgaaaaggatgtggaggcaaagctggtcaggattgtggatgaaatgtccatgacacgccgcggaggaggacgcgatatcgtattctccctttcggcgggctatgtcatggtaccggagcaggggacggatttcgatgacctttaccataaggcggatgtggcgctgtttgcagccaagatgtgcggcaagtgcgcgttcaggaagtatgaggcttccatgaagaacatcaggattgagctggcggagtgacggggatggattttcagggccgccagaccaggcggcaggaaatgccatgtgtagagacaaaatgtataataaatccaattgtatattgtgcatagtcacgaaagaaaacaattatttaaaaccctattgacaaaattgcacattgttgagagaatgaatacataagttgtgagatatcatagagagaggtaacttaggccataactatgcgcttaaagtccctctcttttttgtgtatgttacgcgcggatgtacatgagggttgaacaaattatgaatccatatgaggaggaacaggtatgagttataatattgaagattttaatctggattttttttcattgaagggtaagaatgcggttgtcacgggaggcaacagcggtctggggcaggcgtttgcccttgcattagctaaggcaggggcgaatatcctggttgccagctatgcgctggataagggagaaacccagaagatgattgaggataccggggttaaatatgaattcatccaggcagatatatcaaagccaggaattccgaaacagattgtggagaactgtgtgaacagcctgggcagtattgatatcctggtaaactgtgctggtatctgcatctgcaaggatgttctggatttcggcaggtccgagtgggatccaatgatagccattaacctgacagcggcatttgaactgagccatgaggcggcccgtttcatgattccgcaaaagagtggaaaaatcatcaatatctgttccctgttttcctatttgggaggattgggttcccccgcatatgcggccatgaagcatggattgtccggccttaccaaagcatatgctgatgaattgggtaagtacaatatacaggttaacggtattgcgcccggatactatgcgacggatatcacggttgggacgaggagcaatcccgagacaaataagagggtcctggaccatattccggccgagagatggggggagaggcaggatttgatggggaccgtggtatttcttgccagcagggcatcagagtatgtaaatggttcaatggtaattgttgacggcggatatatggtcagataggagataaggacatggaaaggcagacaatcattgaggaactgggaaaaatagtaccatcaggatatatggtaacagatgaaaccatcttaaaagaacacagtgtggaccggttccgcaaatttgaaaaggtattcggcgtgtatagccgtccggttcccgcggcgctggtgcgtcccaggacccctcaggaaacagcggatatcataagattctgtaatgacaacaagattgccgtgattccccgcacaggcggttcctccattgaaggcggtctggaggcggctgtccctgacagcatcgtagtggatggaagcgagatggaccagatccttgacattgacacatataatatgcaggtcacatgccagtgcggtgtgaacctggaggtgttggaagaaacactgaggaagcttggatatacgaccggtcattcaccacagtcaaagcccttggcccagatgggcggtctggtagccactaggagcatcgggcagttctctaccttatatggggggattgaggacatgctggttggacttgagatggtcatggcagatggtaccattgccagaattaaaaactgtccgcgccgggcagcaggaccggatatccgccatatccccatgggaagtgagggggccctctgcttcatcacggaagtaacggtcaagatatttaagtatatgccggagaataataagttttacagctggcttctggatgatatgaagacaggattcgaaatactcagggaggtcatggtacaaggatataaaccatcctttgcaaggctctatgattttgaggacggggaatattatttttctcatttctgtgaagggaaaccagtgcttatcttcatggtcgagggaccaaagggcgtggcggaggccaccgggacagccatagaagagatagtaacgcatttccatacctataagaaggtggacagccattacatagatacatggtatgccggattgaactggaacgaaggtaaggtggcggaagagtataaattaattgaaaagacccacaatgttgggttcacaacggaaatatcggctaattggagtaatatccatgacatatatgaaaatgtcatcatgaggattaaaaatgaaattccggacatcaccatggtgggcggacattcatcccacagctacatgaacgggaccaatctatactttatgtattattacaatgtggtagactgtgatgtgacggaggaaatcacgaaataccataacccgattaatacaatcattgtggaagagacactgaagcggggcggttccatgtgccaccatcacggtgtgggcaaatacagggtgcggtggattaagcaggagcatggaagcgcataccctgtgctgaaaaagctgaaggaagcgcttgatcccaacaatatcatgaatccaggaaccatctttcccattgaggataattaaagaaaagaggaaagcaatgaaatacatacttgcaatcgacgggggctcccaaagcaccaagttaattatttttgatacccatggaaatattatctgtgaggagagtgaaccgctgcgtccgatgtcacttccaaaggtgggatgggtggaacacccggatgacgatttgtggacatccctggtggcggtcagccaaagacttatggagcggtttgagggtgaccctggtgacattgtgggagcaggcctgtgcagcatccgtttcgaccgcgtgatattaaagaaagacggcacgctggcccagccggcgctgagctggatggactccagggtttcagttccctatgtacatgataatccggaggcagcgtatgtcacatccaccaacggttacctgaccagaaggctgactggggaatgcagggatactgcggccacctatcagggacaatggccgattgatacggatacatgggagtggagtaatgatgggaaagtgatgagccattacaatattcccagggagatgctatttgacctggtgatgcccggggagatactgggatatctgacagcagaagccgcgtcaatcctgcatctgcccaaggggctgcccattgtggctaccagcaatgataaggcggtggaatcgctgggaacagggaccattgactatgaaaacgggatgatttcactggggacttatatatgcggcgcggtccatggggaatccaaccccaaagactgcaggaattactgggtgaattttgcatgtatgcctcataagtatctatatgagagcaacggaatcagaagaggtatgtggcttataagctggtttaaggagctgctgggcgaggaagtgcggatgcatgccagggaactgggcatagggccggaacaatatttggaaacgctggcagcggatgtggcgccgggaagcgatggactgatgatcattccggagtggctagccccggcagggcagccttataagaagggcatcatgctgggctttgatgtaaggcatggggcagggcacatttacagggcaatcatggaaagcatagccatgaccatgaaaaacaggatggacgagatgtgcgcggaactgggaatcactctgaagcagataactgtttcaggaggagggtccaacagtaaccttttcatgcagatttttgcagatgtctttggggttcccgccgtgcgcaatgtggtaaacggtgcggcggccgtgggtgcggcaatctgtgtggctgtggcagccggaatatatcctgattttgggacagcggcgaaggagatggtaagggtgaaggatatcacagatccgattcctgcccatgcagggttatataaaaaaataaacgaaggaatttatagcagccttacgtcagtgacagatggtctgatgaagcgggcatacgacatttttgatgggaattaatctggcgtggaaaaggcatcggtgtggaaacggtgccttttcgctcggcagggaccgcggggtgggaaaatgaaacttctgggatgttttaagatagtgccggacttggagcagctggccgaagaggaatggaagccggatgaacaagggattattgatacaagatttgtcaggagggaatggaactgttatgatgagagccttctggaattaatgctcagggccagggaccaatctgccaggggggagacgttggaggcattgaccgtaagcggtacgcttcaggatggggttattaagacactgtatgccctggggttcgataaggtaatcagggccgggacctgttccgggatagtgttctccccatatcatacagccaggcttatcagcagctattgtaatgccggacagccggattgtctcattttaggggcacagtcatctgatgaagggagtggaatggttccctatcttgtggcagagatgctgggatggccctgtgtttccggggtcatggattttgcgctggaacaggaccggggtattgtggcagaacatatgcagttttctaagaagatgcgccgccgcatgaaggcgccctgtgttctggtcgtgggcaatgtaccgaatacttatctcaggatccctaccctgaaagaacggctcggggcgtcggggcggaaggttgaggaatggggaacggaccatgtcaaggaggaaaagatggaaccacagcttgttaagcttgagaggaagggacaaagccgtgcatccatacatctggatgtggatgacacagaagaattggtgcgcaggctgtatctggaacatataggcgggaggatgatggacagttgacctgttatctgattttgaatatgtgggcaggggaatgggagcgccagtgggcgggactgtggcaggcgtatattaatatatgcagctgctgccaaagcgtcagggtaattgttttttccggtctctcccatgaacttgggtttgtccagggacttaaggtggatggtgcattgatactggaagatgcattctataatccggagaacctgctgtcagaaattgaaaaaaatagtaatagaaatgccgtttacatattcggatatggtgattattcacatgagatggctgtaaggctggctttcaggctgggaggggattccctgacagccgtcaaccgcttttggtttgagggcggctgtattcttgccgcaagaaatgtttactccaataatatggaaggtactttctgtgtaaaacgttttccgttctgtgtaagtctcgtccgctcaacagaaaagaccgcgccagggatttcgggaccgataccggatgtccggagaaaaaacatatcagataacagtgggtatgtgatggaatactcagaagagccggttggaacagattgctccctggaagatgcacggatcctgattgcccttggaagaggcgtacggacgaaagaggactatcgtaaggcggaggaactggccaggatgctgggggctgggattgtggcctcgcgtcccctggtaatgcaggggattgccccgcttgagagacttgtgggggcatccggcatcattgcacacccaaggctgtgcattgcggcgggggtgtcaggggcagcggcattttacgtgggaatagaaaaaagcggctatatcatagcaattaacacggattcggatgcattcatcatgagccgggcggatgtggcggttgagcgggattacagggaagtatttggggcgttaagaaaatatcttatagaggaggaaatgccggatgattttgcagatggaggaaaaatttgaggattatcttcgggacgaatctaagctccaggggtatgcggatagtatctcatttccttcgagtgaggatgatatacggcagatcatagaaggaaaccgggaatcgtgtattaccatccagggaggaagaaccgggcttgtagggggggcggtccctatgggggggcatctgatgaacctttccagaatgaaccgtatcttgtcttatgacagcagctgccaggataacgccatcctggtggcggagcctggggtatcactgatggaactcgaacaggcaatccgttgtaacagcaggaaaaggcctatgttctggccctgtatgcctactgagaaatctgcaactgtaggaggatgtgtggctgcaaacgccagggggatttacggaaacgtgtatggtccggcaggggaatatgtggaggaagtacgcctgatgctgtccagtggggaaatcgtggaagcctccagggacaaggacagccgccttttggaagaaattgtgggaagtgagggcatattgggggttatcacccgggtaacgctgcgtctggtacccagacctgcctgtatatggggactggccctgtttttcagggaagaggggatgggagcggcatttgcggacgctattcctgctgatacagggaaggaggcatttgtggcagcggcagaatggatagacagaagggggattgaactccttgaggagaggaaaatgtccatgagcaggctcagggacttcccggaaattgacagacagtacagctgcgccgtccttctggagcttcatgcccaggatgaggaacatatgctggaactggctggacgcctgatggaactgagcgccggatacggcgctgacccggactgcacatgggccatggctggagagcaggaagcatgcaggctgcgtgagtacaggcatggtgtggcggaggcagtgaatatgaaggtagaagaaaaccatcgccggtgcagcaggattgtgaagctgtcctcagatatgaccatggtggggggattttccgggattttgggccaataccgcggcctgctggaccaatcaggcatggatggcacaatctttggacatataatgagccgggaccttcatatgaatctgctgccggtcaatgaggaagaatatgggacagcccggaaaatccttgagggactggctggacaggccctgtgcggcgggggaaggcctgtcagtgaacatggagccggaaagataaaagctgggatgtatggagtgatggaaacccggaaacggatggccaggaagcagtcttttgatcccgggggaatgtggaacagaggggatgtggcaaacgatggactatgcggtatgtatcaaacaggtaccagccatatcggaaggggatatggatgagcggacaggtaatcttatccgaagcggtttgggacaggtgtgcaatccctgcgatctgtctgctttggaagcggggatacggatgaagaggcagatgggggggactgtgaccgtgttttccgtgggaccggattcagccaggtccgtgcttatggacggggtggccagaggggcggacaggggggtcctcatctcggatccggcgttgtccggcgcggatgtaccggcaaccgcatataccctggcccaagccataaaaagtacaggacaatatccctgcgtgctcacaggaaaccataccacggacggggatacaggattcgtaggggcggctttggcacagtgtctttcttatgcgtacctgtccggggtaaaatccatagtaacaatagaagaggatgggattaccgtgatatgtgaaagaacaggatacacactgcgtatgaaagcgttgtttccctgtgtgatttccgtggagcccggtgtggcggcacccgcaataccgacattttcaggcaggataaaggcagggaagatggactttgcaaagataggggtgacggatctggaagatacggatgcaagccattatggcagcgctggttctgcaacaaaggtgaagcgtatatatcctcctgtcagggaaaagaagacggctgtgcaggtggctgacggggtcacggcggccagtatgatatgggagaaattgcatggatagggcggatgggagtgtcagggataccggaatcctggtttttttggaaatgactgagggcgggatatgtgatgtgggcctggagatactctcccatgcggcagacatggcggcccgggcggggatacccttgtatgccttcctgcccgataacagggaattggccggatatccggtgaggaccgtatactgtgcctctgagtccctgtgcgattcggaggagcttcagtttctggcgctgaaagagtgtgtggcggcatgccgcccatccatccttctgattggcagcacctttctgggaagaaggcttggggcccagcttgcagtggaatttggcaccggggtcacagcggactgcactgccctaaagctgtatgatggggaatgtctcctgcagacaaggcctgcttttggcggaaatgtcatggcggacatcatcacgccagacagaaggccgcagattgctaccgtgcggccgggaacatatgagaagaaaatggcgggcagtgggatgcgggtgcccaggataatcattcctatggtcagtgccggccggcgggagtgggtgctggagcggaagcggccggaaaaggaatggggccttcaggaataccggacagtcctggctgttggcaggggacttaagaagcgggaggacatattgctatttcaaaagctggccggctatctggatgcagggcttggatgcagcagggctttggtggagaagggatggatgtccccaaggcatcagattggcctgtcgggaaactatatacggccggaagtggtcattacttttgggatttcaggctctgcgcagtttctggccggtttgaaatcgccgaaaatgatgattgctgtcaattccgatcccaaggctcccatatttgacatggcacacctgccggtctgcgccgatttatatgaaacagcggaggcattctgtggtatgttttcatgatttgttgtataatagaggtcatcaatcaatttggttgaaacataggggaaggggattactgaagatatggaacaactgacaaaagagatattcctggatatgacggagcggtgcccggtcatacccgcaatcaagaatgaccaatggctgtccgcctgcaatgaatcggaatcagagattgtatatctgatatatgggaacatatgcaatatcatggaacatattgatacgttgaaatccatggggaaatatgtggtagtgcatgtcgatctgattgaggggctggcattaaaggaaatcagcgtggacttcattaaaaagtataccaaggcggatggcataataagcacgaaaccggggctgataaagcgtgccaatgaactggggatgtttacggtacagcgtttttttatgacagatgcactgtcatatgccaatattgtaaaatatgtgcataataccaatcccgatgtggtggaactgcttccggcagggctgcccaaggtaatccgttaccttttggaggagatacagcgcccggtggtggccagcggcctgcttctggataagaaggatgtcataaccgcgctgggcgccggtgtacatgcggtatctactaccaaccgtgaactgtgggactgctgagaagtggcaatacaccagatcggcagggctttagtggcagcattcaatggaaaaagcagtggattaggaaaaatcatcctgtaatccactgctttttacgttcctatgaaatcatccggcatcctccatctgatcatcctttggcaggctgctatcaggatgaccttcattgccgtccggtccgctatccattaatgtgggccgggataccaccttcatcagggataccatgcacaggataagcaggaacatggctggaaggccgccaaaggcggaaagctgtttcaggcctgccacgccctgggtattaatcatgagaatggctatggagcctatcaggataccccataatatctttaacacagttggcgcttccgggttttccggattggttcccttccagcagaggccggacatggcattgattgtggaatctgccgccgtgacaaaggaaatgaatgtagcaaatacaataagcgggattgtaatctttccaagcgggatgaagccaagcacctggtacagtactttttcaaacccctcggcctgaatcaggacgtacagatcctggacgttcagatgatagtagattgcgctgccgccgaagataccgatccagaatacgcagaacagggatgggacagccagattgatcttaatgaagtccttgaccgtgtggccgtaggatatgcgtcccaggaacagggcggtaaccggagcccaggccatccagttcccaaaataggagatggtccagaagtgggtccagtgttccggatccagggtaccggtaaaaagattcctggtaaaaaagttgtcggcaaatacaccaaaggattccgtggtcaggttaagtatatacgcagtgggccccatgataaaaagcatgaggatgatgaccatgaacaggcgtacattaaaagtagacaggaaacggatgcccttcatcagcccgctggcagaggagatgatgaatacagtgatgatgacgcaggcaaccagggtccacagcgctggcctgcttgcgattccggtaatatttgagaccccgccggaaacacttaatatgccggtgccaagggaggatgccataccgcaggccatggtgaataggcagatgctgtcaagcagggaaaggcatttctttgtgcgccccagtccaatggcaggggaaatacagccctggaaactatagggctgtttcatattgtaatatgcaatggcgaacatgagtcccgggacacagtaaatcgcatacggtgttatggtccagtggacaaacatggtggacagggagaacatggcggcttcgttggaattgggttcaatacccaggaaagcaggaggggctgccagatgaaaaatcggttcagccgcagcccagagaatcataccggccgccacggtggtacacagacttacggcaaaccattcccttacccccagaagaggtttggcgtcccttcctccgataaccttgttgccaataggagaaaaatagacgatgacacagatgaccaccattgccagggatgtaagtgtgaacagccagccgaaattgattttcacccatgtgttgagtccctggacaatgcccaggaatgcatctgtctgggtaaggcagaggatgactgccagtaccataaggatgaatgttggaaagaaaacggtctttctgagttttttcaatgtaacccctcctaactaaaacaatacggatatgatttacaggacctggccggaggcgcttctggggcggaccagggtgcgtatgtaacgtctgcctcctggaaaatccggtgtataatcccaatcctcatcaaagttgttattagcgctgtctatgatgcgctttttctcatgggcagtggtatagtactcaatgatatgttcagggtggaagcggtctgtaattgattttctcatgctctcaaccagggacgcatactgtggttcatcaatcagatcatgcatttctgaaggatcctccctgagattgaacagctggcccttgaactcatggatatgtatgagcttataaccacctcttaccacggcgtagcatggccagaaagttccgtctgcgtggaattcaatgaaaatatccctctcttttacggactcaggtttattgatataatcaaagaggctgacgccgtcggacggaagcctgctggcgttaagtgttcccgtgatttcacggatggtcatacctatatccatgagggaacatggatccgtgatggtggtgccggcatgttcctgtccgggaagccttaggatcatggggattcttgtggcccactcatggaaattacgcttttgtatcatgccgcggtcaatcagcatatccccatggtcactggtgaacatgattacggtattatctatcaggccttcgtcctccaacaggttcagcagttctcctatcctgtcgtccacataggttgcgagggcagcataggcacgtctcgcattctgcagatggtacgggtctgcaaggtcaatatccgttatgttttcatgggcattgatccagatatcctgtatgttctggggacaagcctcaatttcttccctggaaggcgcatccatctccatgtccttgtacaggtcccaatattttttgggaggcatgaacgggtcgtgtgggttgtgggtggataccacaaggcagaatggttcgtgcgcattctcctttccaatcccataagcattaggtttgccaggataggatggggaatccggatcccagtaaaagttgccgtgtatgtattcctttgcacggaaaaatgtctcatcatcatagttcacatagaggttggattctgttgggaaacacaggtccccgctgtaatggactgcgtgtgaaggatattttgggggcggcgcatccggggattttggcttgccgaaccaatcctcaggataatgggccttatgtcctttggacgggtcaccttcatccgcaaaggagggtttggggacaggataccagttaaaggaaccggggtatatatctgtcgtcagtctgcggttgaagccatgaagctggtcaggcccaagaaaatgcatcttaccgctcagtaccgtatcataaccggccagtttggcataatgggcaaaggttggctcgtcactggcaaagggtgatgcattgtcataacagtccagctcactgcaaaggcggctggtcatcatggatgcccgggccggggcgcacaaagggcatgaggtgtatgcgttctcaaaacggattccttcccggcacagacggtccaggttaggagtcatgacctgtttgttgccataggctccggtcatgaagggtgtgagctgatcagccatgattaacagtatattatatcttttatccataactccctcccatgtgttaagtgaatatcattcatagtcataggtggcctgcatcacggcacagcatccgttgggatccagctgcccgtcagccttaggggcatccgtccagtatgcttccagatccctccgccaggtgagggccttttcttccagttctttggccagttcaggcatttcttccaccaggttgtgttcttcgcccatgtcctgggataggtcggagagccagacctcatgctttgtctctgttttcgggtccagggggaggctccatccatccctcaggaagccattgatgacaagcttgtaattgccgcgtctgactgcggtctgctggcccatttcccagtacaggcagtccttgtcacgcctggcgccaatggtcattacaggaaggatatcgcatccgctgatttcataatcagaagcattgcctccggctgcattgatgaaggttgggaatatatcggtacccatgcacggttcgctgatgacctgaccggcaggaaccatggcaggccagctaaagatggccggtacccgtatgcctccgtcaaaaagactgaatttatgcccttttaatccgcctgttgatccgccatagtagtagtctttcctctcatccagccagttcctggattccttggacggcccattgtcactctggaaataaatgattgtgtcattgaagatgccccggcgtttcagatagttcatgatctcgccaaccccgtcatccaccgcactgagcatggcggccataatctgcctgtcttctggaaggtgtttaaaacgttccagatatttatagggggcatgcatcgggtaatgaggcgcattgaatgcacagtaaagggcgaacggcatgtccttctccacctgctcccggatgaattccaagcccttccttgcaaataattcggtggaatattcccctgtatactttaagcagcgctcatcattttcccataaatcatgattggggttgatgccgggatgggaattggcttccgtgtagtgaatatgtgagaaataatcattcacaccagaaagaaagccgcagaaatagtcgaatcccatatgggtgggtcggcattccggcacggctcccagatgccatttaccgaccattccggtagcatagccaagatcctttaatgcacttgcaaaggtcggtattcctggattcaggctggtggttgtcttaatcccgccaagaattgagcggacacctgtcatgtagggataacggccggtcagcaggcaggccctggatggggaacatacagcgcttccggcataaaaatcagtgaatcttgcccctccggcagccaatatatccagattgggtgtgcatacatcggtggagcccatacaggataaatctccataaccctggtcgtctgtcaggaatacaataatatttggttttttcataatcgtctcacctttctgaatgggttggtttgatgccataacaaaaaaagaatgatgtgcccgtctcaacggcacaaccattctcttatactctgctggcttatagcgctataaagttatcataggatatttgtcagatgttgtcaatatgatgactataaaaaaagtttttttaagcagtatagacaaaaacacacactatttattgacaattatcacgaagagaaaaatgcacattgacaaatggaaaacgctagtgtagaatgagcccataggtactaagagattctagaggaaggtatttacctgatttgtgttgggtaattctttcctcttttttgcgttgttttttataaatacgcagggcagaatcagacactccttatgtaaaagtccgtaccggtgcggggtttcatagggtaccggtacctgtgaaaaaggggaagggaaacagaaagattatatgatgaggagggcattttcaaatgaaacaaaaatggacgttgaagcgggtaatccagttctgctgtctgtgtggggcaggcctgatgtattatgttccttatggattcagcatttattatgatacctttatcgaagcatttggggtgagcaacgcacagcttggggcgattcagagtgcatataccatggtgtccatgtttacgtatttttttggcggattggttgcggataagttctcagccagaaagctgctggtattctcctatgtggggactgccgcgcttactttctggttcggtatgttccctgcctatgcggttgccctgctgattatggggctgatgggcttcattaacacggttaccttctattcagccatgatgaagggggtccgtatctttgcgggagaaggtaatgaaggcatgggaatgggatggcaggaagcgttccgatgcctggtggcctccggtgcttccatcctggccatgttcttattcagtcagtccgctgatgatataaccggactgcgcaatgtaatctggctgtttgcggcagccatcctggcaatcggtatcctcagtttcattttccttgaaagggatgtggtaacccaggatgcggaccacaatcttatgaataaccttaggatctgttttaaggacgtaaacatatggctgatttcgttgatagtagcctgtctgtatatgtccaatgtggcaatccggttcatgaccccgtttgcaaccagtatttttgggattactgttttaatgggagctgttttgggcaatttccgcgagtatatgcgtccttttggcgcatttgccgcaggttccctgtcaaccagggttggaatcacaaaggccatgttcattttctcagccatattctgtgtcctgaattacggactggcattcatgccccagtccaagagtctggtatatgtaatattcattatggctgcggttggatggattgtgctgggcgctatgagaggcctgtattttgcgcccattggggaggcaaatatatccatggccataaccgggaccgcagtggggattattgccaccataggatatattccggatgcggtcatgcccatggtgtacggtaaaatcatagactccttcccgccggaacgggcgtaccccataatatttacaatcgccgggaccagcatcctgctggggcttgtgctgatgcttgtgttcatgaagagaaataaaaagagcatagcggcgctgatggaaaagaaacgccgggaggccactggttcctgataatttcataccagccgcttgaatggctgctgtccatcctttgtggtggtagttcctggcttcagggaactatcaccttttttggattatggcacagatgaatattaggcctaataaagacttgccacattttgtgaatgggcaaggaaatattaggtctaattttgcgcttttaaaagtaagacacaaataaaatagttcttactattgtaatatgtgcataatattagacctaaaaattaataaatattgcacatagacacaacggcaattaatttatataataaatgcatgaaacaaattagacctaatattatcaaacaacatgggtcggggaatcaacaccgaaaaagcaaaggagaatcattatgaaatcaagaaaaatcatggcgttactttgttgtaccgtactggcagccggtctgaccggatgcggcggttcagggacatcctcccaggttacatccgcagccggacaggaagcggcagggacctcagaggcggcaggacagaaaagtgaaggggccgcggcttcatcagatgcagccccgcaggatgacaagacctttaatatcgacctggccacggcctatgcatccgatggtccggccggaatggcccttctacagtttgtggcagatgtggcggagcagtccggcggcaccatcaacatcagcctttttgcagatgggaccctgggaagcgcttccgacaactattcctccgtggccagcggggacctggacatggccatgaccggactggagggactggatctttacgcacctgaatacaccttcctggactgcccgttcctgattaaggacgaagcccacctgaaagccctgctggacagcgggattggtgataaactgaaagaacgctatgaggaaaatggtttcgtgaccctgggctggcaccagagggatgtccgtgaactggcttccaacaaggaagtgaagtccccggccgatgtagccggattaaaactccgtcttccaggcatgaccgtgtacgtggatacatggagcgcgctgaatgtaagttccaccacggttgccatgagtgaactttatacggccctgcagaccaaggtggcagaggcctgcgagggcggctatgagcagatggataccctgaagctttatgaggtgcagaagaatattgctgagacagaccatgtatatgagtttgtgggattgttcatcaacaaggacctgtacgattccatgagcgacagccagaggcaggtattgaatgactgtgcggctaaggacctggcctatgcggaccagctggccaaggaaaacagggagcagtacaagaaggactgcctggacggaggcatgacgttagtggatgtggaccgtgatgcattccgcgatgccctgacggattattacaagcagcagtttgagacaaaatggaccgtatctacatatgacgaggtcatgagctacgcaaaataacaggacaatccggccggggcagcgggcagtattttggccctgttacccggctggtttcatcaaggaggtcttcccgcatgttcaaaaaaatcgcacactgttatcttaaaatagtggaaaccgtctgtgtattccttctgcttttaatcctggcctgcatgtgtatccagatttcctgccgtctgcttaccattggacagaattttacagaggagctttcaaggctgagcttcagtctccttatcttccttggggcgccgctggcgctgacggagggagcggatattgctgttgatatggttgtgaatatgcttccccaggcagcacagaggatcatcagcatcctggtcagtgccctcactgcggtattcagcgtgttctgtatccgaagcctgattacatttacaggaagcaaccagggcgtcaccgctgtttccatgacatggataaaaatgaactggctttactatgcgttcatgttttcctttggctgcatgctggttgtctccatcataaaagcaggagccgccatccttggaaaaccccagaccatggatattaacgcagaagcaaaagaaaaggctttgcaggaagaaaaggaggttgacctgggcatatgaaacttattataattgtaatcctgatctgcatgctggccctgttcctgttaaaggtcccggtatatatcagcatggcccttaccggctgtgctttgatgatggctaccaccggaatgaagtggagtatactaagccaatatctgtatacaggtaccaactcattcaccctgctggcaatccccctgttccttctggccgccaagctgatgaatacgggcgggataacgaggaagctgtttgcgttctgtatgaaggtggtgggctggcttccgggaggcctgggccatgtgaatatcctgtccagcgtgatttttgccgggatgtccggcaccgccgtgtcggatgccggcgggctgggggccatcgaaatcagggccatgaatgaaaatggattcgacaatgacttttcatgctgtgtaacagccgcttcctccacgctgggtccgatcatacccccaagcatccccctggtggtatatgccaccgtgtccggcgcatccgttggggctctgttcatggctggaatcgtacctggcattgtaatggcattaatcatgatggtggtcgtcaccatctatgcggtcaggcgtcattatcccaggaccaaattccccactgccagggagtttttccacgcgctgagggaaggtatccttccgctcatggcccccttcatcctgctggtgggcatctacggcggcgtgttcacccctaccgaaagcgctgccatcgtggtgctttacagccttgtgctggatgtattcgtttaccgtgaactgaccatgaagaaattcatcgccatcctgcgggaaaccgtaagggattccctcaccattgccctgatcatagcaggcgccaccttctttggctatgtggcgaccagggccaagatcccgcagatgatactggcttccatgaccagcatcgtgtccaataagttcacgctgttaatcatcatcaacgtgttcctgctgatcatcggctgctttctggagactgcgtcggccattaccattgtggttccgctgatccttccgcttctggctgcctatgacatcaacctgacccagtttggcattgtcatggtgctgaacctgatgatcgggcttctgactcctccgtttgggctggtcctttttgtcatcagcaagattggccatatttccatcggaaggttttccaaagccctggtgccgtggctgggcgcccttctggcagccctgttgctggttacctttgtcccccagttaagcctgtggttccccaccctgttggggatgagcgtgtgatgatggctctccgggatgtgttttgatattgtatctattaagaaagaagaggaaattaccatgaaaatcacagcagtaaaaggaatccccctgggctgtacctgttcccccatcagtgacgccctgtcaacctctgctgccagacaggcgcttcttgtgaggatagagaccgactccggatattacggtatcggtgaggcatttacatacggggccccgctggctgtcatgaagtacattgtggaaatgcagctggcccccatcctggttgaccaggacccggcgcggattgaattgcattggaacaccatgtactggcgcaccattgcccatggccgcagaagcatggtaatgggagcaatcagcggtattgacattgcactctgggatctgttgggaaaaatctgccatatgcctgtgtataagcttctgggcgcgtgctcggacacggtcccgtcctatgccagcggaggtttttatgcaccgggtaaagggattgacgggctgagggcagaacttgagggatatatggaaaaaggctatcaggatgccaaaatcaagattgggcgcaacctggaccgtcccggttccccgctgcgttacatggcgaaccaggaatacagcgtgaccgtggaagaggatatcaggcgcatggagacagccagggagatccttgggccgggccgcctgattgtggataccaatgcgtcctgggattcctatacggccatccaggccgggccggagctgcaccgcctgggtgtgtgctggctggaggagccggttccctttgaggacctggaggggatgcagcggatttccagggagctgcctgacatactggtggcgggctgtgagacacagcaggggctgaagaattttgaaaccatggtgcgcatggatgcggttgatatcctgcagcccgacatcggctgggcgggaggattcacggagtgccgcaagatcggcgccatgggagaggcggccggacggaaggtttccctccactgctttggttccgccgtgctgtttggggccagcctgcacctggcggcatccatggccaatacggaaatgatggaatccgaggagaatcccaatcctctgaaaacagacattgtcaaagagccgttccaggcagaccgccatatgaacttttacgtcccccagggggatggtttgggggttgagctggactggacgaaattggaaaaatatattataatgatgtaaaataactggaattaagattcaataaggtccagtgctgcaggggagagttgccacatgggaaagaggcatgaaggacctgagctgcttgcggatgaggtggcacagaaaatcagggcaaagattcagaatcaacaatatcagccaggggaccgccttaccgtacgtctgctctgcgaggaattcgggaccagcgagaccccggtcaaacaggcgcttaaccagctggtcgcaacgggccttgtggtatccataccaaagtgcggcatgaaggtgcggacctttaacttccaggacatgaaggacaactgggaggcgcgcctgatgatagagcagttctgcgccgtgcctgcagtggagcgcgtacgccatgacgaggatttcgtaaagcatatccaggacctactggatatctccaaccgagaatacggcaagtgcattgcggattttacaaaagagaacttcaacctcctcaccgagcatgacctcatgctgcacacggaactggtcagatgcagccgcaaccagcagatcatgaatatgtacaacagcctgaatgcccattcctgcatgtttgcaggatatggctgccacaccccggagaccctgcgccaggtacagaaccagcacacggagatagtggaccagctgttgctgtgtgatgtggatggactgaggaaggcgctggaatcccacatttacagtacggtccagatttacaggtcggcttggaaggaataggcttccgggcaaaggcggtgaaaggtgatgcctgaaagaaatgatgaaaggaattaccattgaaagatgtcataaaacagacaggaagacaggaatccaccgtctagcggattcctgtcttcctgtctgttcatatccctgccagacggcagtggttccggtttctaaaggtccagcttcagatccccttctttaatccatcccatcttccttaaaatctcaccaaagataaaagtaaggactgcaggaagcacaaagcacaccataaggattccaatccacatactggaaccgcctcccatggcggtatagatcccgatggggcctaccaggccgcaggtgcccatgcctgaaccggcagggatgttctggagacggaagaccatggtggcaatgggtccggttatcatggatgccagtgtgggaggtatccagatgcgcgggttcaggacgatgttgcccatctgaagcatgctggtgccaagcccctgggccatcaggccgccaatcttattctcccggtagctcatgactgcgaagccgatcatctgggcacagcagcccgccgtggcagcgccccccgcaagtccgtccagggaaagggcgatgcagatggccgcgctgctgatggggagggtgagggcaatgccgataagggctgaaaccaggatacccatgatgaagggctgcatttccgtggcggtcttgaccaggttgccgaaccagtccatgaatccggccaccccgggacctacaaactgggcaatgagcacgccggagatgatggtgacgccgggagtcacgatgatgtccaggcgggtttccttggatacgatcttgccaagctccgccgccacgatggtggccaccagggcgcctacggggccgcccagggtgttgccggcgattcccacggtggctgcggagaacagtaccagctgcggtgcctttaaggcatgggcaatggcgattcccagcgcagcgcctgtggcgcttttggcatagtctgcaatcacgttgaagatttcaataccgaactgctggcccagggtaccgaagatggtcccgatgagcagggatgcaaaaaggccgaaggccatggctcccagcgcatcaatcagataggtctgtacggtgatgttcacattttttcgtttcagaaactccttgacactcgtcgatttcatactcatacgctccctcttttagcggtttcggaaaaacacaccctaaggtgtttttcaaccatgctttagttagggattttatcatagttttataaaaatgcaagttatttcgattagaatacactagattgtgaaaatattaacatattgcaaatttataggcagtgggatataatggtacgaacaggggacattatttttagaactgcattgcatgagcttcagcggtcagagagaggtggacaaaatcgaattccgttttttatatttactgcaggagctgcacactccgctggttgatgggcttatgaccttcatcacatccctgggggaccatggcatattctggctgttgctggccgccgtgctttttgcggtcccaaggaccaggatgatgggcgggtgcatgctggtatccatcggtatcggtttccttctggggaatgtggcccttaagaacatggctgccagacagcgtccctgctggctggatccgtcggtacagctgctggtccaggttccccgggatttttcatttccatccgggcattccatggttagctttgaaggggcggttactgttttcatgcttaacaggaagtgggggataccggccctgatgctggctgtgctgattgcattttccaggctgtatctgtttgtgcatttccccacggatgtgctggcaggagcggcgttggggaccgtgattgcctggtgtgtggccaggacggcaaaaaggcggcgcttaaatgatcctccccggacaatgacagaaaaatcgtgacagaaagacaggtggcagatatgttggaacgcgcaccgggtatctatgaagtggtgcttcacagcaatcagaaaagcattgatgagataaagattttcctcattcccggcagggaaggggagcgcagcctgatggtggatgccggtttcaggaaaaggcagtgcctggaaaccatggaggaagccatgggaagccttgggattacgtatgataagctggatattttcctgacccacaagcaccatgaccactgcgggctggccagcgtctatgcggagcggggggccaggctgttcatgaacccccaggaagacaggcattgctatgactgcctgtactataaccacagccatggttcgaaagaggaccagccagaggtgctgagggccgtgggcgtgacagaggaagggacgcccgaggtctggaacatgttcatggaagtgaaccggcgggtcagcgagcacaagggctgggaatttgagattccgggattttcctatacgcctgtgaaggcggggcagatcctttcctatggaggatatgattttgaggcagtgccccttaagggacataccttcgggcagctggggctttatgaaaagaaccgcaggatactgttctgcgcggaccaggtcattgacgggattgtccccattgtgggtaccacctacccggatgagcacctgctgatggggtattttgaatctctggagcattttaagcatgagtatgcggactgcctggtgctgccggcccataagcttccggtggcggatgtgaagcgggtggtgaaccggatcgtgtttgcctatcttgacaagacggacctgattaagcatatcctggaccatggccatcacaggatgaccaccaaggaggtggcgtgcctggcttacggcatggagtccgtgccaagggatgaggcggagttcatcaagcttaagatggtgatcagcaagacattttcctgtctcgaatacctgtatgacacggacttcgccatccgttccaaggaggatgggatttattactgggaatccccgtaggcgcctttgttcaacaaatattagcaaggattctcccatcctctaaggtggtgagatgaattgccaaaaacaaacttaacggcagtggtgggcggagagtaatcggtatcccccactgccatgaagtcaaccacgcatctacgtaggatgcagtcgcacttcgacaatataccgggcgtggattgaaacaaaaagtgcttgcatatttcaccatatggtgtatagtatagtaagtgccgtgttgaacggcataataaaatattgaaaagcagagtaggcatatgtgcgttaagtgccggctgaacagggagttgtcagctggacgaaaggaaccttcggtttcctgcggtacataagccgcatcccgctgcatacagagatgatggagcggcctgactgcgcggattttccgtgcagggccgctttttgtgccttccatggatgcaccgccgtgcgcggggcagcccaatggcaatacctggcatgctctccgtctgtagtacgagaaatctgcaaaggaggtaattgccatgaaacgattcaatgaaacattcacaagttctttccgggaactgaagcaggtgaggaccatcacggtctgcgccatgctggcagccattggtgtgatcctgggctccctgaccatctacataacagatacggtcagggtaggcttttccgggattcccaacatgctggccgcctatctgttcggccctgtggccggaggcgtgtttgccggcgccctggatatcctcaagtacctggtaaaaccaatggggccattcatgccggccctgaccctgatcgtggcgttaaagggcctgctgtacggatgcgcgttttacaaaaagcccatcagcttctggcgggtactggcaatccagctggtggttgccattgtctgtaacctgcttttaaacacatgggcgctttccctgttatacggaaaggcattcatggcaatgctgataccgcgtatcatgaggaacctgatcatgtggcccatcgattccctgatcttcttcaatgtggcaaagatactggaggtgacaggggtgttccgtgccctgggcaggagcagggctgccgcataaaagttattttattaacggatgaaaaatttaacaatatctaggaatgggaaaatgcctccggcggacctgtaaaatggtctgccggaggcattttcccgtataaaggcccagggcagggccgtgggcagcaactggaatatcatgggaaattccccgtgataccgttaattttgcgtcaagctgttctgcaaaaagtacaccatcgctcttgcagccgtcctaaggccgtgctatgatgggtctgcaaaaaacggaatgaagagaaaacagatgaccatgtttcaaaatgaggaggaaacataccatggcagttcatgtaattgacgaagcagatagatgccttcaatgtaaaaaaccgatgtgccagcagggatgccccatccatacgccgatcccggccatgatcaaggcccttaaggaaggcggccttgaggatgcgggagccatgctgtttgccaataatcccatgtcccttgtgtgttcccttgtgtgcaaccatgagcgccagtgcgaaggacactgcgtcctggggaggaaagggcagccggttcatgtgagcagcattgagaactatatatcggatacatgcctggagaggattaagatagactgcgcgcctaagaacgggaaaaaggtggctgttatcggggcaggtcccgcaggcatcaccattgcaatcatgctgacccagaggggctacagcgtgaccatatttgattccagggacaagatcgggggcgtgctccagtacggcataccggaattcaggctccccaagtccatcctggaccgttataagaagaagcttctgtccattggcattaaaatcaggcccaacaccaccatcggcggcgcactggagattaaggacctgttccgcgacggatacaagagtattttcatcggcacaggggtgtggcgtccaaagacccttggggttaagggggagtccctgggcaatgtccattttgccattgattacctggcgaacccggatgcatatgatctgggggataaggtggcaatcatcggcgtgggcaattccgccatggacgtggcccgcaccgtgatccggaaaggttcccgccatgtgaccctgtacgccaggggcaggcactctgacgccagcctccacgagacacagtatgcaatgcttgacggggcaaagtttgaattctgcaaggggattgtggaaatcaatgatgacggtccggtgtttaaggacgtattctatgatgaggagggcaatatcaccgggtattcagaggatacggaacaggttcacgtggattcggttgtcatctccatcagccaggggccaaagagcaagctggtcaacacaacggacggcctgaaggccaccaggaacggcctgcttcagacctcggagaatggcgccaccacggtggaagggatatttgcctccggcgacgtggtcctgggcgccaagaccgtggtggaggcagtggcatattcaaagaccgtggtggatgccatggatgaatatatgaaggataaataaccgtccggcggcatgggattttcccgtcatacacggtttggctggctgcgtgcctgccggatatgaaagagcagataccgttcccttttgggaatcaggtacctgctcttttcattatcccatactgcatgattggatttaaaagaccgcagtactaccccatggtcctcctaagcttccggaaggatattatgaacaacgtaaccgtggtacataccgcaatggtatccgcgatgggctctgacaggaaaacagcaaacaccttgttctcaaaaagtccgggcagcacatagataagcgggatcagcaggatgacctttctcagcagggccaggaacagggaggtcttgctgtcgcccagggcgatgaaggtctgctggcaggccagctgggcgccgaagagcagggcggccgccatatagacatggatggaccaggtactgaaggcggtcagggcagcgtcctttgtaaagatggagatgaacacccccggtgcaaacatgctgacagcccacagcacggtggaataacacatacatgtggccagcaggatccagaaggtgcggctgacccggtctatcttccttgcgccgtagttgaagctgatgatgggctgcgcgccctgggtcaggccctggagggggaggagggagaactgcatcacgcttcccatgatggtcatggcgcccacggccacgtccccgccgtattttaacagcgaggtattaaagcagatgttcaggatgctttccgtgaactgcatgacaaatggggccgcgcccagtgcgatggcaggcatcaggatatctgccctgggcttcatataacaggggcgtatctttaagtagcttttaccggacagaaggaacagcaccacccaggtggcggagatgccctgggagataatggttgccagggccgcgccccgtacccccatgtgcagcccgaacatcaggattgggtccaggatgatgttgcagacagcgccgatgagcacggtaagcatgcctgtctttgcatatccctgggcattgatgaatgcgttaagcccaagggccagctgcacgaagatggttcccagggaataaatctgcatgtaggcccagccatattcgatggtattgccgctggcaccgaacatcagcaggatgctcctgccaaaggtcaggaagaatacagtgagcacaagggccaccgcaatcagggcagtggtacagttgcccaggatgttctcagcctcctccttcctgcccttcccaagcatgatggacgcccttggcgctccgcccatgctcaccagggcggcaaaggccgagatggccatgatgaccgggaatgtgacacccacaccggtcagggcgctggcgcccacgccgggcaggtggccgatgtacatgcggtccaccatgttgtataaaacattgatgatctgggcagtgatggcaggaacagccagcttaaacagcagccgtcccacgcttcctgaacccaggtctatttcttttgcttcttttgcagaacccataaaaattcaatcctttccatatataaatatccgaatgtctaaaaaacagccgtttaataaatatatatccaaaccagaagaaagtcaataacggtacttccgcaaatgtttccatactgctataatggtaacagcctcttgacaggagcgcgtgttttcgggaaaacgggacggaaaggaaggaaaggacatggttaaggcgatattttttgacatagacggtacgctgagaggatttaatcaaaaggggatttcagaggataccagacatgcccttgacagggcaaggaatgcggggatacggctgttcattgcgacgggccgccatttcctggaggtggaatcggagaacctgctggagggactggcatttgacgcgtatattaccctgaacggccagtactgctatgaaggaacccctggccgtccggtcatctataagaaccctatcccacgcagccagattgccatccttcttaagatactggaagggacaccattcccctgtctgttcatggaagcggaaaactggtatctgaactacgtggatgagcgtgtgatccgggtgcaggatgggatcggaaccaggattcctccggtgggggatgtgaggcaggccctggaacatgatatataccaggtgatcccctatcttaatgaaagggaagccgtcaggctggcagccttcctgccggaatgtgggtatacggtatggcatgacggggaaggcgtggatttaacccccaagggcggaggcaaatgctcaggcatccgggaagtgattgcccggtacgggattgaacctgaggaaatggcggccattggggacgggaataacgatgcgtccatgcttgcatacgcaggcattggtatcgccatgggcaatgggaccagaaaggcccttgaggccgcggatcatatcactggcaatgtgtgggaaggcggtctggcccaggcaatcgattatctgctgtcacaataaaacagtccattggaggggggagtgcaccccctccttttcttatggtagtgattacccttacggaagcggctgcccttacagaaatgattgcccttacggaagcggctgccctttacggaagcggtttccttttatggaacagcagaagcagccccatatagcagaggcacaggaacaggatattcactgctgtctcgacaaagagcggcaggctgccaagggaggctgccacacaggagaatgccaggtacatcccaatggatatgagaaggaggatgaccggcttcacaatcatgttggccgtgtcccagtggaaagggacctgccgtttcactgccaggaaactcataagcgccagggccagctcgctggccagcatcccccagagataaccctggatcccaaaccttggaatggcaaaaagcacaaaagccagccgtatgaccatggcccagacattctggaaaaacgtgaccgaggttttcccaagtccgtttaagatgcttcccatggtggtggccagatacatgaacgggcacagccatgacaggatggtgatgaaggtgcctgcattctggtcatggaacacgcccacgcccagctggttaccgaatagggtgaagatgccgatgcacaggacccccatgtagcagctgtagcgcagggacatggaaatcatggaggagatacgtccctcgttgccgtccgcctgggcctgggcaaccgttggaagcagcaggacggccatggaattggtgatggcggaggggaacaggatgaacggcagggccatgctggtgagcacgccgtatatggacagggcctctgagttggtaaggccggaactcatcagcttgttgggaatccagattgcctcggcgctgccaaggacattgagtatcagccggttgcccatcagtggaagggccagggccatcagtggggcggctgtttcacggaaggagagggggattgccttccttatcttattaccctccgttccggcaggcgggaagaatccaaggcagaatacggtaaatgcagccgaagccatttccccgattaaatgaccgtataccgcaaggctgaccgtgatctcacgtcctgaatccagccatacgccggccataaggaacacggcccccatgcggatgacctgttccgccacctgggagaacgcgggcaccctggccttctgcatgccataataataaccgttgatacaggcgtggagggctgcaaagggcacggacacggccatcacgggcaggtaaggggcgcaccttggttctaacaggaacttttccgccaggaaaccggcgttgccgtaaatgccccaggccaggaggaatgacatgcccatggcaatgaccaggcctgtcttgaacacggccctgccccgggcctggttggcggccacgtactgggacagcgcggtctggatggagcctgcgcacaccgcgaagcagatgctgaatatgggatgtaccatattgtaaatacccagcccctctgcgccaatggtccgggacatgaatatacggtaaaaaaatcccaggatacggcatatgaaccccgttgaggtgaggagcagtgttcctgtaatgaatgccagcttccgtggggagaggcgtttggatatgtttgaagatggtgttaaggactccttcatgagaactccgggaaatgggaattattaaaagtatattgggagcgggcgggttttatgacattccaggcccccttcccggtacattaagaaatcataaggacagcataagaaaagcataaggatagctaaaaagggcacgctgcagcattaagataccataaaaatagtgttaaaatattgttaataatagcctgttaaaatttcttaacaggcatattttttgtgcataatatataaaaagataaaattttactaaaattcacaaaaacttacggtaggagagtcccgccatctcctttataatatttttataatgacttagtcagtaagagctcgctgcggtcaggtttcttaatgccatcatcaaaagaagggagagtgccatgtcatctctgtttcaaaccattgacaagatcaaacctgtatatgacaggacctatgcattcgtcatgttcctgtgcaaactgctcctcaccgtggatatcctcatcacctgtatggcggttgccggacgttacataccgtttatcccggacccggcctggagtgaggaggttgtgctgacctgtatggcctatatggcagtgctgtcagccgccctggccatccgcaggaatgcccatatccgcatgactgcctttgacacctatctgccaaagcaggtggtgcgggccctggatatcctctcggacgcagctgtccttgtgcttgccgtcatcatgattaccgtgggctggaagtatgcaaagggcattggctccaagggcttctatgtgagcatgccctggctgtccaggttctggatgtatttcccggttcccctggcaggcgtggcgatgctgatatttgagctggaagccctgtataaccacataaaagcaatctgcaccagagaggaggaatgatcatatgggcggtgggaatactgcaatcctgattttacttgcaagcttttttgccatgatattactgaggttccccattgcgtacgcagtggccctttcctctgtgctctgcctgctctaccagggtctccccctggcagccatctgccagcagatggtgaagggaatcagctccttcagcctgatggcggtgccgtttttcattgtaatgggctgtctcatgggctcgggaggcatctctgagaaactcatagccctggccgatgcctgtgtcggatggatgcggggcggcatggccatggtgaatattgtggcatcctatttctttggagggatttccggttccgctgcggcggacacggcctccatcggttccatcctgatccccatgatggtggaacagggctatgacgatgacttttcaactgcggtcaccatcacctcctcctgtgaggggcttctggtgcctcccagccacaatatggtcatctatgcaaccacggccggaggcgtttccgtgggaagcctgttcctggcagggtacataccgggcgcgctgctggcggtttccctgatgataggttcctatatcatttccgtgaagcgcaattatccaaagggcgacccgttcagcatttccaaccttttaaaacagctgagtgtgtccttctgggccctggcggccgtgctgatcgtggtggtaggcgtggtgggcggcgtgttcactgcaactgagtcggctgccattgcggtcatctacagcctggttgtcagcgtgttcatctaccggggacttgactggaaaggcgtgtggcgggtcatgggagagtgtgtggacacactgtccattgtgctgatcctcatcgcgacctccagcatattcggttactgcctgacccgtctccatgttccggtgatggctgcaggtgccataacaggttttaccaacaaccccatcatcctggccctgctgctgaacctgatcctgctgatccttggctgcatcatggacatggcccccatcatactgatagccacgccaatcctgctgcccattgccacctccatcggacttgacccggtccagttcggcatcatggtagtgttaaactgcggcatcggccttctgacccctccggtgggcgccgtgctcttcatcggctccgccgtctccaaggtgcccatggagcgggtggtgaaggctaccctgccgttttacctgtgcatggtcatcaccttgctgcttattacgttcatcccggccatcagcctttggctgccccaggtgctgggctagagcctgtttgaaaattcattcccgccatctgcacgccccacttcgcggtatatttggccccgattcagtcggcgtagcccactacgcctccatcatcgggaccaaatctcccacaaagtgggacgcacatctgacggaaagcaattttcaaacacgccctaggattacaatcaaaatcatacttgagggctgtcccggcagggcagctcttttttcagttgtttgcaagaaacagggcgcatggtataatagagggaagcccatcgcaatgggacaggcgtacgggaggtagtcatgaaggaactcatatggggaaaaacgctgcgctcgcggctgatacggtacaattttttcattatctgcgtcattgccatatttgtcagtgtgtgcacttacataacggccagccgcaagacgctggaggtggccaagaactcgctgcagcaccaggtggagggggtatcctaccgctaccagctggcctacgaggaaatgatcaacatcgtgctcaactgcacggagcgtggaaccttcaacctgggggaagtgggcaggcagacaacgcctgcggccaggaagaagggactggattatgcggagcgcatcaaggattactgtgcaatcacggagtacggggactatattgtgaagctgtccgtctttgacgacagggggagccttgtgcagacaggcacctcctttggaagcacggaggatgccagggaaatattaaaaggcggctggctggaggacgagttgttaaaaacaatggacagctatgagctggacctggtgcccaacccgtttttccagcatgagggaaatgtgctccccattgccaggaccctgggcagcagcgccgcgcctgggggctgggtggtgttaagcctttccacccagctgttccaggatatgctggaggatgcgggcggcggccaggaagccgtggtggtgaccggggacggcaagcgggtggcttccctctacgagccggaggaacacagggaggagaatgacaggatcatccggagccttctggactccgggaaggataaggggcttcttgagatgaaggtccacgggaagcagagcctggtggcctttgagaaataccagcgcagcggtatcctggtatatgagaacctggccctggacagcctgaccagcgaccgccttatgatcatccagaccgtcatcatcatgttcgcggcctgcctgatattcgggttcatcctgtccgtgctcatcaccaaccagattaagaagcccattgaccgcctagtcaggcacatcggggatgtggcggccggggactttacaagggaccctgatattgagggtgaggacgaaatcgggaccgtgggcaaggtggtcaatgacatgtcccagcagattgacggactgatggcggaacggctggagaatgaaaaggaaaagggcgtgctggaactgaaaatgcttcaggcccagattaatccccatttcctctacaacaccctggattccatccgctggattgccgtcatccagaaaaacagcggcattgtgaagatggtgaccgccctttccggcctgttaaagaacatggctaaaggctttgacgagaaggtcacccttcagcgggaactggatttcctgaacgattatgtgaccattgaaaaggtgaaatatgtggagctgttcgacctggaggtaaaggtggacgatccgaagcttctgaacgccatggtaatcaagctgacccttcagccccttgtggaaaatgccatcttcaacggcatagagccgaacggcaaacacggcaccatcctgatccgcgcatatgaggaagaaggatgcctgctgatccaggtaagggatgacggccgggggataccgaaagagaagcttgccgccatccttgacaacacggaaaaggtcaagggcaataccatgagcgggattggcctacccaatgtggagcgccgcatcaagctgaattacggggagcagtacggcctcaccattgagagcgaagaggggaaatatacggaaatcactgttaagatacccctggaatatgatacaatcgtggggcggggggatggagccgatgaaaaagataaggggtaatgagatatgtaccgtgtgatgatagttgatgatgaaccattgatcctggccgggattgcatccctgctgaactgggaggagcacggctgtaccgtgggggccaggtgcgccaacggccagcaggccctcaggcagatggaggaacagaagccggatatcgtgataacggatatcaagatgccgggcatggacgggattgagctgatgaagcaggtcaaggacaagggatgggacgatgtcatcttcatcctgctgaccaacctggaagagttcagcctggcccgccaggccatgagccttggggcagtggaatatctggtgaagatggaactgacagaggataagctggctgacagcctgaaggcggccgtggcccggcgtgaaatgaaacgcaaggcagaggcggccgataccgtcatggcccggtcggaggaggacatactgaaagagtatatagagggacttctcatcgggcgaggggagatggtcaatggggatggtacggggataggacgcgatgtggatatccgggccgatgtggatacctggggtaatgcagatacccgggcggatgcagatacccgggtcaatgcagatatccggaccgatgcagaccggacggcttctggtaccatccctgtattccgggaaccaatcatggccatcatcagtttcaactatggttatgagggattttcctctgatttcacaagggaggaccagaagaaggtaatctcctttgcggaaaatatcatcgggcagatggtaaaaggttattttgaccacagctgcctggtgcgcagggaactgaccagcctggtgctggtggtttcggcagagggcatgccggattacagggagcagatgagaagccttggggagaaaatcatttccgtggtaaaggactacttcgaggtgtccgtgtccgtacatgtcagcaccaggaaggagagccttgaggactttggcgagcttctgtatgaggccatgagcgcggccaaccattatttttactgctttgctgacccggttgtgttttattcggctgagtgtgagacaagcgccagacatacggcaagcttccatatcggattcctgaaaaaggatctgtcccaagccgttgccatgaatgacagcgccgccctggaagggatattggaccaggtggtatgcctgctaaaggaaaataacccctccaggcagcaggccgtgaacgcctgtgcaaacctgtattttttcctggcctccttttttgaggaaggggaggaagaggatttcccctatgaggtcaatatcatggaaaaactggggaggcttgggaccctgggccagatcatacagtggattaactggtttaaggcagccgtttcctccattttagaacgccgcagggacacgcgggtggataagattgcggagatggtgcgggaatatgtgatggagcactataaagagcgcataaccctgggccaggtagcggaagctctgaacatcagccagggatatttaagcactgcctttaagaaacagtccggggaatcatttaccagctatgtgtccgccattaagatagaaaaagccaaggagctgatagaaggccatcagtatatgatgtatgagatatcggacctgctgggctttgacacgcccttttatttcagcaaggtattcaagaaagtcgcggggatttcgccgaaggagtacgaggcccagtgcctgaagcagaaaaaattataaaaacatgaaaattttacatgtaaaaatcatgcccacctgaaaattttgtaaaaagtatgttgagggtggattcggttcataaaacctttctggtatgattatatcaagatttgaaataacaaattttaaggagggttttattatgaaattaaaaaagacagtggcactggcattggtaacagccatgacagcaaccatggcagctggatgcggcggatcatcttcggataagggcgctgcaccggagaccacggcggcaggaagcgaggcagcggacagcaaggagacaaaggcgcctgaaaccggcacaggggagaagcagaagctgaccgtgtctgtctgggacaatgacgctaccccgcagttcacttccgttacaaaggcatttaatgagaaatatccggacgtggaggttgagttcattgacgccccgtccgatgaatataacaacaaggtaacggtcatgctggctggcggcgattctgacccggatgtcatattcgtaaaggatacagagaaccaggtaaccatgaaggataagggacagatcatgaacctggatgaatatattgcaaaggacggcattgaccttgggatgtataacggggttgcggaccagttaaagatggacggcaacagctatacgcttccattccgtaaggactggtacatgctgtactacaacaaggatttatttgacaaggcaggtgtggaatacccatccgctgacatgacatgggatgagtatgaggaactggctaagaagatgacaagcggcgagggaagcagcaaggtatacggaacacacaaccacacatggcaggccctggtttccaactgggctgtacaggatgggaagaatacccttatgagcgaggactacagcttcttaaagccatactatgagcaggctttaaggatgcaggacgaaggcgtgctgcagagctatgccaacttaaagacaggcggcatccactacatcagcgtatttgagcagcagcagtgtgcaatgcttcccatgggttcatggttcatcgggaccctgatccaggataaggatgcaggcaagtttgactttaactggggcgttacagccattccccatccggctgacaccaaggccggtgcaaccgttggttccaccacaccggttgcaatcaatgcaaaatccgatgtgcctgacctggcatgggagtatgtgaagttcgtcaccggcgaagagggcggggaagtcctggccgacaacggtatcttcccggcagcagagtccgaggccatcagcagcaggctggccgcaatcccaggattccctgaggacagccaggatgcgctcaagaccaccagctgggtcctggaccgtccgctggatgccaagatggcagccgtaaggaaggttctggaagaagagcatgatctgatcatgattggcgaggaagatgtggataccggtattgccaacatgaaccagagggcccaggaggcaagggaagactaaggattcacgggataaaacaaagagcgtctgattattcaaacacgccctggtttaagggcgtggcacgcgctgacgtgctgacggaggttggacgctctttttgtgccttaaaataagtgtgtaagcgtgtttgaataagggatatggtgatggaaatgacaggaaaacagaaaaaagcattgaagaggaacgccattggctactctttcatacttccgaattttatcggatattttatctttatatttgttccggtaattctgacctttgtattatgtgtgatgaaatgggacggctccagcgcgcccatggagtttgtagggcttaagaatttcgtgaagctgttccatgacagcggctttcggatttcagtcagcaacaccctcttttatgcggtctttaccgttccccttaccatggtggcggcccttctgattgcagtgctgctgaattccaagattaagggaatcgtggtttaccgtaccgcgttcttcttcccctatgttgcctcgctggtggcggtgggcgctgtctggaacatgctgttccagcctgagttcggcccggttaatgaattcctcaagttcgtcggcgttgccaatccgcctaagtggtgcgcgtccacggactgggccatgattgtcatcatcattgtcagcgtgtggaagtacatggggtattacatggtggtgtacctggccgcccttcagggcatttcccaggacctgtacgaggcagccagcattgacggggccaccggctttaagaaattccgctatatcaccattcccatgcttaaacctaccaccttctttgtcatcatcatgatgaccatccagtgcttcaaggtatttgacctgatttacgtcatgacgggaggcggcccgggacgttccaccaatgtgctggtgaaccatatctacaacgcggcctttgtggacttcaagttcggatatgcaagcgcaagcgccctggtgctctttgccattgtgctggtggtgaccctggtacagttccagggtgagaagaagtttacggattacgtataggaggcaggaagatggagacaagaacattacatagcaaagttataatctatacactgctgaccgtactggcagtcctggtggtggttccctttttctggatgcttctggcttcggtcaaaaccagcaacgaggtgttcagcattcccatgcggctgttccccaaagagttccagtggggcaattaccagacaatctgggataagattcccctcctgacctttttcaagaacacattcaagattgcggtcctgacaacgcttttacaggtatttaccagctgttttgcggcttacggcttttccaaggtggaatttaagggaagggatatcctgttcctgatatccgtgaccacctttgcagtgccttggcaggcatatatggtgcctcagtttgcgctgatttccaggatgggccttacggactcccatctgggacttatcctgatgcaggcattttcagggttcggcgtgttcctgatccgccagttcatgatcggcgttcccaatgaactgctggaggctgccaggattgacgggctttccgagtacggcatattcgcaaaggttgccctgccccttgtgaaacctggtattgcaaccttggtcatctttacttttgtaaatatatggaatgactttatgggaccgctgatttatttaaacagcaccagattaaagaccatccagctgggcatcaggatgttcatttcccagtatggcgcggactatgcgcttatcatggcggcttcggtgtgctccctgattccggtccttgttgtgttcatggtctgccagaaatggtttgtggaaggaatcacggctggaggcgtaaagggctgatggagaaggaaatggatgaaaggatagccatggatgaaaggacagccatggatggaagggcggtcatggatggaaagacggccacggatggaaagacggccgtatacggagccatatccgatgactggaagtggtgcagcgagtactgccaaaattactggcccgaggaatgcgcccatatcctgcggattgcggatgatgcggtaaggcagaggttcgtgttcgacctgccctgggacatggagcagaccgtcagggcagtggagttcggcggaaatacgggcgggattgactggcaatacatgccggacggggatccggagttcatctaccagtttaaccgccaccgttactggatctgtctgggccaggcctatgccatgacgggggatgaacggtatgcggaatgctttgccagccagatggtttcctgggtagagaagaatcccatcacgaaagagacaaaaaggaccacatggcgcagcatcgaggctggaatccggggagagaactgggtaaaggccatggaatattttaaggacagccggaccgtgacagatgggataaaggccgtgttcaggaaaggtctatgggaacatgggaattatctcatgaaccaccggacgcccttcagcgacaagagcaactggggcgtgctggaaagccatggactgttctgcatcggggccgcacttttgcgggagtccgggcaggcgggacagtccgcacaggagggacggtccgtacagcctggacagcccatgcagacggagcatcccattcagccgtacagccccggtgaagccgccctctatgtggaggaatccctgaagcgcctggtgcgccaactgtccatccaggtcatggatgacggggtccagtgggagcagtcccctatgtatcacaacgaggtcctgcgctgcgtgctggaggtcctgcgcatggcacgcctccacggcatccgcgtgccggacatcctgaaggacaaggcacgggccatggcccatgcggacctggcctggatgaaaccggaccatacccagccctgtaatggggacagtgacaggacggacctgagggatgtgttcacacccgccgcattcttactgaaggacaaacacctgcggtatgccggatatggacgtcttgactttgaaagcgtgtgggaactggggccggaggccgccatggaatatgaaagcatgaagtctaaggaaccggagcagcttttttccgtcatggaacacagcgggaactggtgcctgcgctccggctggcatggggacagcgactacctgcatttcaagtgcggttccctgggcggcggacacggacattttgacaagcttcacatcgacctgtccgtccacggggaggatgtgctcattgattccggcagatacacctatgtggacgggggcctgcggcggcagctcaaatcctcctgcgcccataatgtcccggtggtggactggcaggaatacacacagtgcaccggctcctgggatgtaaaggggacggcctgcgccacgggacagcagtggtgcaggaagggggaatttaccttccttcagggaacccacctgggatacctgcccgctggagtcctggtgaaccgccggattatttccatcggcaccaggatccatgttatcgtggacgggttctatggacagggaacccatgtgtgcagccagattttccatctgaacccggctggaaccacggaaattaaggggaataccttcctttatcatggaagggctgccgaggccgtgtttaccgtgctcacccccggcgctgccctggaacttgaggataccccggtttccttccattacaaccaactggaacagggaccatgcgtcagcatttccagggaaaacagcctgtttacttccatggtgaccgtcattacaggttacggcggggaagatggggaacggtgcgacatccggcgcgtgcctgtcattgcccctgttaccgggcgtcagcttggggacggggaggcggaggcggtccgcatccgggaaggagggcattcctggctggtggtcatcaaccacagggagacaggggctgacagcgaatacatcggcgctgacggctgctacggcctggggcgcgtgatggcctgcgatgaagcgggatatggggaaccggcccaggggacggatatcccaggaatcccgggaacttcaggacgtccgggaaatccagggactccagggaccgccccgctgatgaccgtgcttcaatggtaggacgcacaatggaaccataaggatcatgatgaggagcgattatgcagacaaaatccagtttactgacatataagaccataagcaatcaggaggccggggagtaccttgcaaaggcagtggacctggtgagggggaacctggaccgatttacggaccgctttccatactccaacagcgaaggaggattttaccagccaggtgataaccgggagtggaccacagggttctggaccggggaaatatggctggcctacgagatgaccggggagcaggtattcagggaagccggagccgtccaggtggaatccttcctggacaggattgaaaaaagaatagacacggacaatcacgacatgggctttttatacaccccgtcctgcgtggcagcctgccgtctgacaggcagcaggacagcaaaaaaggcagccctgctggcggcggataacctgctggagcgtttccaggaaaagggacagttcttccaggcgtggggggaactgggagccagggacaattacaggctgatcattgactgcctgctgaacatgcccctgttattctgggccagcgaggtcaccggggacatggtttaccgggaaaaggcaatcgcccatatacggacggccgtgggctgcgtcatccgcccggaccgttccacctatcacacgtatttctttgaccctgatacagggaaacccttaaagggcgtgacccatcagggcaaccgggacggctctgcctggagccggggacaggcatgggggatttacggctgcgcactcagttaccgcgtggaacacgacccgagatatatggaaatgttccgggatgtgactgattatttcctggaacacctgccctcggacctgatcccgtactgggactttgactttgacgaccccagtggggaaccaagggattcctcctccgcggccattgccgcctgtggaatgcttgagatggcaaaatacatggaaggacaggaggcgtcctattatacggatatggccagacgcctggtaaaggccctctgcagcaggtgcgcggtaaagagcaggaaggagtccaacggcctgctcctccatggcacctatgccagggacagcgcgggcaatccctgttccaaccggggcgtggatgaatgcaacacatggggggattatttttacatggaagccctggtgaggctggtaaaggactgggagccatactggtattaaggcgggcatgttttttggtatccgcggtattgaccgtccggatacatcgggtttatcataggagtgtacactgcctgcagtcaggggctgcgccgtgtacgctcctaattgtatttgtcatgtcatgtttggggacagggggacaggcagatgagaaaacttctgtttgtgtttttttggcttgcgggattggaactggttgccgcagcagggatattagtgacatccggtatctataatgacagcagccatccggccgccgggcaggggaaccggtatggggattaccaggggacggtggaaggggagatttacatttacaaggaccatgacccgcgtttccacataatcacggacccggtactgaccgacaatccggtgtcatattcaggaggactggtcatactggagcgggacggtctgtatggatacgctgattttgaaggaaaccgtgtcacggacatacaatatgaaaacgcaggccggttcagcgaagggctgtcagacgttaagaaggatgggaaatacggtttcatagatgcatccggccgagaaatcatccctgtgatctatgaccaggtatccccgtttgaaaacggatatgccgcagtcaggctggatggcaaaagaggcgtgattgacaggaacggcggcattgcggtgcccattgagcacacccatctgtttaccggtcatgatgacattgcgcttaccggagccaatataaagacaggcgaagggaaaggggattacaggaccatatacggatttgtcaattacagggaaggaacccaggtcccttaccagtaccaatccataagcaatctttcggacgggtattacagtgtcagcaaaggggcgggatatgccctgatggaccctcttggcagggaagtgacggagccggtctatgactggattggaagcgtcagcggccggattgccgcggcctgtctggatggcagatacggctacatcgacctggagggaagggagatggtgccctttggatacgacgccgcatttttattctgctatggccgggggtcggtttcaaaggatgggaaatggggatatgtggacaggaacggccgtgaggtcattccactgtcctatgattttgcatccaatttccagaatgggctggcagtggtcatcaaagacggcagatacggcctgattgacaccaatggaaaaccgcggatcccaatccaatatgactgggtcagcgcgctgggggaggatggtgtcattaccgtcatgaaggacggccgtttcgggttcgtggatgcgaagggaaatgaaatcgctcctgccatatatgatcatgtctatgactttaacggcggctatgcaaaggtggagctggagggaaagaccggatacatggaccggcggggaagacttgtaacccccgctgcctacgatgacccggatggagataaaaacagtgggacgagtaatttctaccttcagcgggacattggcggggatatgatagaggtgccccttctgccggatgtgaatgtccgtgtaaagaaggcggacagctctttcaccggctggtatcacaaaggctggcaggtcactgggttctatgacaatgacggcaggaagctggcaagccctggagacggatatgaggtgtatatccttcctcccagggacgtatcctatacctatacagggtgttatggaaaggcaatgatgttctgttataagaatggggacagatacggcctgttctgcgtggcggatacggacggtccggaatagggcatccggggtggatattgtcactgttttgcatataataacagtaccagacaaaatataagtattcctattgaaattgtaggaatactatgatatagtaggaagcgtagatgaagcttttaactttaggactacagaaaggcggatttttaatatgaaacagttgatttatcttgataatgcggccaccaccaagacaaggccggaagtggttgaggccatgctcccgtatttcacggagttttatggcaatccttcctcggtctatgatttttccacagagagtaagaaagcggtgaaccatgcaagggagaccattgcccgggcattgggggcaaagaccaatgaaatatattttacggcaggcggcagcgagtccgataactgggccctgacagcaactgcggaagcctatgcttcaaagggaaaacatatcatcaccaccaagattgaacaccatgcaatcctccacacctgccagtatctggagaagaggggatacgaggtcacctatctggatgtggatgagaacggagtggtcaagctggacgaacttaagaaggcaatccggccggacaccatcctgatttccatcatgtttgccaacaatgagatcgggaccattgagccgattaaggaaatcggcgcaatcgcaaaagaacacggcatccttttccacacagatgcggtacaggcctttgcccatgtgcccatccaggtggatgaatataatattgacatgctcagctccagcggccataagttaaacgggccaaagggaatcggattcctctatatccgcacaggcgtgaagatccgctcctttatacacggcggcgcacaggagcgcaagcgccgcgcgggcacggaaaatgtccctggcatcgtgggctacggcaaagcggttgagattgccatgaataatatggaagagcgcacaaagaaggaaacggaactcagggattacctgatggaccgggtcatggacgaggtgccgtttaccaggatcaacggctcacgcaccagccgccttcctaataatgtgaactttgccttccagttcattgagggcgaatcacttttgattaaactggacatggccggaatctgcggttccagcggttctgcctgtacgtcaggttccctggacccgtcccatgtgctgctggccatcggcctgccccatgagattgcccatggttccctgcgcctgacgctgagcgaggaaaacacaaaggaagaaatggattacgtggtggagcagattaaggaagtagtggcttacctgcgcagcatgtcgcccttatacgaagactatatgaagcataacaaacacaacaaacaaaattaagacagaaatccatcaggaggaaaacagatgtacaccgataaagtaatggaccattttgagcacccaaggaatgtgggtgaattagagaaccccagcggcatgggaaccgtaggcaatcccaaatgcggcgatatcatgaggatttatctggacattgacgagaaccagatcataagggatgtaaagtttaagacctttggctgcggcgctgccgttgccaccagcagcatggcaaccgagcttgtgaaaggcaaatccgtacaggaagccatggcagtgaccaacaaagcagtgatggaagcacttgacggactgccgcctgttaaggtacactgttcattactggcagaggaggccatccacgccgccctctgggattatgcacagaaaaacggtattaccattgaaggactggagaagcccaaggataatattgaggaagaggaagaagaggaagactattgagtaagaaggttgtagtaggcatgtccggaggagttgactcctccgtggctgcctggcttttaaaacagcagggatacgatgtcattggcgtgaccatgcagatatggcaggatgaggatacggatgtccaggaggcagaagggggttgctgcggcttaagcgctgtggatgatgcccgcagggttgccatggacctcggtatcccttattatgtaatgaattttaaggaagagttccggacgaacgtgatggactattttgtgggcgaatacgtggctggaaggacccccaacccgtgtattgcctgtaaccgctatgtgaagtgggaatcgctgctgcgccgcagcatggcaatcggggcggattacatcgcaaccgggcattatgcgcagatctgccagcttccaagcggaagatatgcccttaagacctcggtgacagcacaaaaggaccagacctatgcactgtataacctgacccaggagcagctggcccgaacgctgatgcctgtgggaagctaccacaaggacgagatccgcaggatggcggaggacataggcctgcaggtggcccacaagccggacagccaggaaatctgtttcattccggaccacgaccatgcccgcttcatagaagcctatacagggatgcaggtccctgaagggaattttgtcgacctggagggcaatgtgcttggaaaacacaagggaatttcccattacaccataggccagaggaaagggctgaacctgtccatgggacatcccgtgttcgtggtggagatacggcctgagaccaatgaggtggttatcggggaagggaaagatgtatttacaaatgtcctctgctgcgataaactgaactggatggcaatagacggcctgcatggggaatccatggaggtcactgccaaaatcagatacagccacaagggttccccgtgcaccatccgtgagattggccgtggtttggtggagtgcaggttccatgaaccggtcagggcagccacgccgggacaggccgtggtgttctatgacggggactatgtggcgggcggaggtacgattttatgagattgcagataaaaagatatggggccgcggccctggcaggaatcatggcaggcagcctggcgctgacaggctgcggcagctatgcgtcaagcagtgaactgaggcagcaggcggaagcctcccttttggaccaggcggacagcgggagcgggtccggccagggcctccaggtggaaccggacagcgggacaccggacaatccgggaacacgggatggccaggggacgccggacggccaggatgaccggaccggagggccgtcagctgaaaccatccgtgtggagaccgggcttacaaccgcccccatgcctgaatttgagtccgtgaaggacgatgtatatgtcaagacagaggatgggggaagcgtccgtctgcgctcatcctgcgacacgggcagcgatgccaacatcgtgacatacgccagttccggcaccaggcttacacgtaccggaaagggaagtgaatggaccaggattgattacaacggtaccccggcctacatatcatctgcatttattaccacggacgtgccggagacaccggctgcaccggctggcggcgtgtgtgtggacagcggggaagtgacgctgaacccgtcctggaagtatgcggagttctccaaaatcaacacaggggctgccgtcctgtaccgttcagaggcagggaccaggaagaacatcacaatctgcgtcaacgcgggccacggcaccaagggcggttcatccgtgaagaccctgtgccatcccgacggcacgcccaaggtaacaggcggcaccactggcgcaggcgccacatccgcggcagccgtgtccggcggcatgacctttgcggacggcacggcggagagcaaggtaacccttgccatggccaggatcttgaaggataagcttctggcggcaggctatgatgtgctgatgatacgtgaaaatgatgacgtccagctggataacgtggcaaggaccgtgattgccaacaatgccagcgactgccacattgcccttcactgggattccaccaccagtaacaagggggcattttacatgagcgtgcccaatgtggagtcctacaggaacatggagccggtcaaatcccactggcagcagcacaatgcgctgggggaaagcctggtggcaggcctgaaaggcgccggggtaaagattttctcaggcggttccatggctatggacctgacccagacctcctattccactgtcccgtccgtggatattgagctgggggataaggcatccgaccattcacaggcaaccctgaacacgctggcagacggcctgctggccggaatcaaccagtattttgggcaatcataggatactgcacataaaagccttgtttgtttattaacattttcttacataacccttcttataatagacaaaatctgaaaactgcattacaatgggtataacagtttaattattgtcaatataaggagggactttttatgaaatgtatgaaacgcctgctggctgttatccttggcgcagcgcttctctgccctatgaccgcgtatgccggccagacagaggaagccaagacattgtatgaccaggtacaggagaagagcaatgccatcacggacatgaatgctttttatgatttcaagattaagcttggcggttccatgatggagaatgcaggtcttaccgacacagacatgcggctggagatgaatgtcaagatgaaccatctgacggagccggccctgatgcgctacatggcttactgcaggatgaccgaccaggatggcagccagatgacttattccatgtactatctggacggatatatgtatatggatatgctgggacagaagattaagatgcccatggccatgggtgacatgatgcagcagagcatggccagcgccaatgcctttgatgtccccacggatatcattaaggatatgaacctgtgggatgaaggcgagaacaaggtaatcggatttaccattgatgacaaccggatgaatgaattccttcagaccgtattaagctccaccggacttacgggaatggtggacggaaccagcatgagccttcataacatgaagggcgagtatgttgtggatccaaacggcaatctgattaagatgcgccttaagatggatatgtccatgaccatggacggcgagaccatgaccatgagcatggacggcgatgtgggtattgcggatcccggccagccagtggatgttccggttcccaatgttgccgagtacaccgatataacggcagcagccaaccagtaataccggccagttataaaaaagagtaaaaaagttatgccagctactacacaaaacacgaaatttagtgtataatgcagtagttggcattttttggaggagtacccaagtggctgaagggtctggcttcgaacaccagtaggtcggtagcaccggcgcgagggttcaaatccctcctcctccgtttgaaacgcccggcgcgggtatgggcatccattcctgctaagcgtactttagaccgtcagttcatggactggcggtattttcatgtctgaaatccaggtattcatatctgaaccccaggtgttcgtgtccgaacctcaggttttcatgtccactggccccggttccggggtattttcaaaaatatccaaattaaatgggactttttccggcattttacagtctaatagatagaagcatggaaaacatgtgactgtacgtacagaaaagagaggaacagcaatggaaaacttaataaagaaagcaaaattgcgggatgcggatgcttttacaaagctgatgcagaagcagatgcagaacatgtacaaaacagcccgggctgttttatacaatgaggaggatgtggcggacgccatatcagataccatactggcatgctgggaaaaaatcggacagttgaagcaggatggatatttcaggacctggatgacccgcatcctggtcaacaagtgcaccgatatcatacagaagaaaaagcagttctgtctgatggaagatgtgccggagattccatcccgggataatggatatgaggacacggaatggaaggaagcgctgaacatgctgggtgagcggtaccggttaatcatgatgctgtactatgtggaaggttttaaaatcagcgaaatcagcagtatcctggatatcgccgagagcacggtcaggacccgcctgtccaggggaagggaaaaactggcagaggattaccgcccggaactgaggaggaaacagatatgaataataaggatatcataaagacattgcaggaagaggtagaaatccctcacattgtacagaaaaaggcagacgctgcatttgcagccatccacagggaagcagaaaacagcaaatccgtcggccccgtcgtaagacttcctgcagacagaaggatgggagatgaccgtggacagcgggggtcccgcaggaaaccggggacacacaggcatcctggaaggaagatatggatagcggcggcagtggcggcgctggctgtgggtaccatcactgcggtggccgattatatgaaacgcagcaagagccttaccgaggggatgcaggtcactgaacagcagcaggtgcagatgcaggaaaagcacctgtcagccatagtgaaccggtcctgtacggataaaggaatcacggtaacggcagtggacagtataacggacaattattacacccatattgccttccgggtggaggggtataaggtggatgtgggaacccagcctgattttgggacaattaaggttacggttgatggaaaggacgggtacgacgaagcttccccggaagacagcttcaattacactgcaggcttctataatggctttatcatgggggaggacgggaaaatcatccaagcggacggcttcccggtacagaccgacgaagccggcaacctcatcgaaaactatacaatggacgacgggaccatggagtaccagattaccctgtccaacacacaaaaaaggggattcttcatcaataagccggtccatgtggaactgtccggtctgggaaccgtggccaaggcagcgtatgagacggatattgacggcacctggacctttgatttaaccttgtccggttcaccggaactgaaagagtgcagccttaacacgccgctgggcaatacgggggcaagtgtggtaaaagcggagatttcccccatttccctgggagtggagtatgaatttccccggcagctggaaccagggaccgcggttgatgaaaatggacaggaaaaagaaaccacattttatgcggagccgccctggctcatgggcgtgcgcatgaagaatgggaccatgtatccgtatatttatctgggaccaggaagcatgggatatgaatcagaggaatccagccgttacaggaccatgtttgccattgaccgggtgctggatgtggaccaggtggaaagcctgctgtttgcaaagcctgcaggggaatgtgggacaacaccggaggaaatgttctatatggtaccggtgggataaggacaggtgctgtatatgtacagccctgatgaatcaggactgcatgccgcgctgggggcattcttccggtatggaaggggttgcgttatcagctcccggaaggtcaatctccggtatgtccccatctccataggtgctgctgttccggcccggaagttccattggttccataggtctttgggtctgtcctgcatccatgttccatcaccctttcgtaaacatgttctccacatagttgcgcatttcctggcggctttcaatggtcctggccccatccacaatccgctcctgttccggtttgctcagtccggcaaagcggttcagggcatcggagtgcatggccagttccatggtaaagccgatgggcagttcatcgttgttaatcttatttatcatgttcatcacctcacggttagtatggaaccgggacagcaaaaatatgcgcgtacattatgatatgaattcctgttttcaaatacgacccagtgcatgacagaaagccgtgaccacatacagtcacggctttatcagggttttccttatcaggatttattttccttataagaatttacttttcttttgatgatttaaaatgttccggttaccgaagcgggaatcgtgaaatcaaccgcccccatataaccgggagccacctcatattctgcaaatgctatcacaagctcgcccctgtcattgaaatagtagctctcgtctcccgtcagacccttgaagtcatcctcaggcatctcggaattgtagaaataaatgatattgtcgtcagccgccatctggtcggtcatctgctgtttgatgttattgctgacagcctccagcatacccggcttatccttaagaagttccttgagggggattacattgcctgtggatttatcaatggtaaatatctttacaaactgggtgccgctggccatggtaagggtggtgtcaatccggatgcacaggtagcggtccgtgtcggtgaccaccttgtagctggaatccagtccataatgcccctgtccgttatccttggcaacctcctcctcatacatggcaatcagctcattggcataatcctcaatggacttgttggcagggacctgagtgtcctgtccattgtccagggtgacctgggggacctttatgtctgcctgtaagtttccgcggctgtcctcaaaggtgcggaaggtaaccactttggcgatggaaccgatgaggggaatctgttccattgcattggcagtggtggggtttaaattggcgagtagtgttatggtcagcatggctgcaacggctgcgccgcctgtcttcttaaaagatttcatgataatcacgcctttctgttctttttttgcctgggcaatgcctgctttcatgcgctgcctggcttcttccggtacggggatgtgttcatattcctgctttaacatatcaatctgtttcgattcgtcctgttttaaatgttcctgcttcatggacatggctcctttctaagacttatccggtatttccctgtaatgctctgcctccaggttcaatctgagcttttttaaggacctgtataatctggcttttactgtgtttaagttgtcgcctacaatatccgcaatatcctccagctttaaatcttcaaagtaccgcagcaggattatggtcctgctcttgtcatccagctggtttaatacagtccgcagctccaggtcccggtactggtcctccaccggtatctccggcagttcctctgtggttgtttccttctttttcctgcgcagcatatccagggcggtgttgactacgatcctgtaaatccatgtggacaggtagtctttattcctgacctttctgcagtccctgattgcccggtaggcgctttcctggaccacatccagggcatcatcttcattgcgcatatagctatatgcaaggcggtaataacgctcatagttatcagtgaggatctgttccgtctccgccgtattgttctgaaagcccatgcaatgcatcctcctttcatttggttctgtctgttagacgtttgaggattccgtaaagttgcatccatttaaacattttatcgtaagaaatcagaaatgcaacattcattgtaatttaatgtgaaaaatgctatattgttaaaaggaatcttatgaaaggtgtacggtagatgagggaagatcatacaaaggatatggatttaaataaggaaatggaagatatccgccaggtacccctggagccggggaacaggactgcttcgggaaaggaaagacccagggaaaggccggtcggcgcttcctatacaggcgggacgccggcgcggcgcagcagcgcgggcggtatggatgaaggcccgggcggcatgccaggacggcgcagcagcgcgggcggtatggatgaaggaatgggccgtgtgccgggacggcgcagcagcgcgggcggtatggatgaaggaatgggccgtgtgccgcgccagcgcagcagtgtgaatgtcacggatggcagcggggcacaggccggaacccagggacatggacgttccagggcaaaaggaggcaggggagcagaggaggtccgctccaggcagggaagaccggcccaggcaggggaagcgggcaggagacgggaaccagggctgacggaaaccaggacgcccaaatccaggaatcagcggaccggaccgccgccgcttgaatccgcgccgcgtgaagtcacgctccccccggttgacgggccaggggaatcctacccgcatccggcaggaaaggcagcccggggcagcggtggcagaaggaaaggtgttcctttcatcgcactcctgcttgtgctggtccttgggattggcgcgggcctgggcggcggttattatctgtggggctgggagaggccttacaccattgacctgaagtcagtggaggtaccggaatgggtaaaacaggaattcatcaggaagaacattttctcaaggccggatgtgagccggaaacggattaataatatcgtaatccactatgtggccaatccgggaagcacggcaaagaacaacagggattatttcgacagcctggcggaccaggacccgcagaagagcggtacatccaccagcagccactttgtggtgggcctggagggggaggtcatccagtgtatcccggtcacggaaatcgcctatggcaatgccccgcgcaatgacgataccatttccattgaagtctgccacccggatgagacaggcaggtttaatgacgcaacctatgaatccgtggtgaacctgacggcctggctgtgcagggaacttaaactggggtcaaaggacgtggtccgccactatgacatcaatggcaagctttgccccaagtactatgtggacaatgaagatgcatgggtacagttcagaaaagatgtggatgctgccatgaaggagctgtaggaacggccccaaaccggatacccggccgccggcaggagaggacggccgctggaatacataggaatcaatacggttcagggctttcaggaaatagaaggttcataatgggaggaactcaggcttgcgtccatggaacatggtataatagcggaacccgcaccttaggaggaagcggcggcattcctggaacccgtagcccagatagtccggggtatgggcatctgagccgatggtgatgatttcgccgcccagttcccggtagcgctttaatatcctgcgggagggattgggctgtgcaaggccgtaccggaggcccccggtattgcactccagccctttgccatgttcgataagctccatgaggatggggtcaatccactggctgaagcgctcataagaataggaagcgttctggtgaggcgcgtagcggacaatgtaatccaggtgcccaaaggaatcaaacacatcatataggttcctggcgcgctctaaggataccttgaaaaattcctccagaccgcgctcctcgccgtaatgctcccagtagcttagttcatagggatccatgccggaaacaaagtggctggagccaatgatgaaatcaaagctggagccgtgttcacggataaactcatggagatatccatccaaatggttctgaagcccaagctccacccctatattaatacggatacgcccctcatattcagcctggaatgccttcatggcagagaggtaagaggggatgtccaggttaaaatccgtgtcacagaaccccgaatcataatcatggtggtccgtgatgcagatttccttcatgccaagttccatggccttttctatctgcctgcgcacaggcgtatctgaatcaccggaaaatgcagtatgcagatgacagtcgttaatcataaatgtttctccttgtggtcaaatcattcaacaggttcattataacagaaagttcccaaaatagaagccaataataataataatttagatgtataaaggtgtgaagatttgtggtataatgaagactaagcattcatttggacataatcaccaaggggatgaaagaaatttccagaaaaagcctgtcctgcgaaaaattgaaaaaaggacttgccatttccagagaaattgattacaatgtaagaaggttgattattatttaacaataatataatttttaacaaactaggaggaattgaatcatggcagtaaaagtagcaattaatggttttggacgtattggacgtctggctttccgtcagatgttcggagcagaaggttacgatgtagtagcaatcaatgacttaaccgatcctaagatgttagctcatctcttaaagtatgatacagcacagggcggatacgctggtgtttatggacagggccttcatactgtagaggctggtgaggattccatcactgttgatggcaagaagattaccatctacaaggagccaaaggctgctgaccttccatggggccagattggtgttgacgtagttctggagtgcacaggcttctactgctccaaggacaaagcacaggcacacatcgatgcaggcgctaagaaagttgttatttctgctccagcaggcaatgaccttcctactatcgtatacagtgttaacgagaacgtactgacagctgatgacaagattatctccgctgcttcctgtacaaccaactgcctggctcctatggctaaggcactgaatgattacgctcctatccagagcggtatcatgtccaccatccacgcttacacaggcgatcagatgattctggacggaccacacagaaaaggtgatttaagaagggcaagagccggcgcagccaacatcgttcctaactccaccggcgctgctaaggctatcggcctggttatcccagagctgaacggcaagttaatcggttccgcacagcgtgttccggtaccgaccggttccaccacaatccttacagctgttgttaagaaggctggcgttaccaaggaagacatcaatgccgctatgaaggctgctgcttctgagtccttcggatacaacgaggatgccattgtttcttccgacgtaatcggtatgagattcggctccctgttcgatgcaacccagaccatggtagctcagattgctgatgatctgtatgaggttcaggttgtttcatggtatgacaacgagaactcctacacaagccagatggtcaggaccattaagtactttgctgagcttggctaattgaagcaataagttgactcatgaggggtccggtcgtttggaccggacccttttttgcgcaggggttcctgcatggaatcttaagactctgaaaggggattaatacaatgttaaataagaaaacagtagatgatttaaaggatttacagggcaagaaggtactggtgcgctgcgatttcaacgtgccgttaaaggaaggtgtcatccagaactacaaccgtatcgacggtgccatcccaaccatcaagaagcttcttgaccagggcgcaaaggttatcctgtgttcccatctgggcaagccaaagggcgagcctgtacctgagatgagtcttgcaccggttgccccggccctcagcgagagactgggcgttgaagttaagtttgtggatgatgccaaggttaccggacctgagacacagaaggttgccgctgaattaaaggacggcgaggttcttctgcttcagaatacacgttacaggattgaagagaccaagttcaaggatggcgatgctgctacggaagcctatgccaaggaactggctgacctgtgcgacggcatttttgtaaatgatgcattcggtaccgcccacagggcgcactgctccaatgtaggtgtcacaagatacaccaaggagaacgtggttggctacctgatggagaaggagattaagttcttaggacaggcagttgagaacccggtccgcccattcgtggccatcttaggcggcgcaaaggtttctgacaagattaacgtaatcaacaacctccttgacaaggttgacaccctgatcatcggcggcggcatggcttacacctttgccaaggcacagggccaggaaatcggcaactccctgtgtgaggctgataagctggattatgcgcttcagatggttaagaaggcagaggagaagggcgttaagctgctgctccctgttgaccatgtagagggcaaggaattttccaacgacacagagcataaggtagtggatgtgattgatgccggctggtcaggatttgatatcggacctaagacaattgctctttacaaggatgcattaaagggcgccaagaccgttgtatggaacggacccatgggcgtattcgaattctccaactttgcagaaggtacactggaaatctgccgtgcggttgctgaactgacagatgcaaccactgtcatcggcggcggcgattccgtgaatgctgttaagagactgggctttgccgacaagatgacacacatttccactggcggcggcgcttccctggaattcttagagggcaaggaactgccaggcgttgcggcagcagacaacaaataacaggacagtttatatgacaaagcgcttttgcacataagtgcctgaaggacgggcgccaagcgctcagtgtaaggagaggggaaccatcatggcaagaaagaaaattatcgcaggcaactggaagatgaacatgacaccatcagaggcagttgccctggttaatgagttaaaaccactggtagcaaatgacgatgtggacgtagtattctgcgtacccgcaatcgacatcatcccggctatggaagctgccaggggaagcaatatctgcatcggtgcggagaacatgtattacgaggaaaagggcgcttacacaggcgagattgcccctaacatgctcacggacgcaggcgtaaagtatgtaatcatcggacattccgagagacgcgaatattttgctgagacagacgagaccgtgaataagaaggtgctgaaggcatttgagcacggcatcaccccgattgtctgctgcggcgagtccttaacccagagggagcagggcatcaccattgactggatccgccagcagattaagattgctttcctgaatgtaacggctgaccaggctaagactgctgtcatcgcatatgagccaatctgggcaatcggcacaggcaaggtagcaaccacggagcaggctgaggaagtatgcgcagccatccgcgtctgcatcggtgagatttatgacggggccacggcagaagccatccgtatccagtacggcggttctgtatccgcatcctcagcgccggagctgttcgcacaggccgacattgacggcggtctggtaggcggcgcttccctcaaaccggattttgggaaaatcgtgaactacaataagtaataagcaagcaatgtatttgccctgcggccggagaagctgactgcagggcatcattctctttgacagcaatgaaaaaaaggagatttttaaatatgagcaagagaccaacagtattaatgatacttgacggctacggccttaacagcaactgcgaccacaatgctgtgtgcgagggtaggacccctgtcatggaccagctgatgagccagtgcccctttgttaagggcgaggccagcgggatggcagtgggacttccggaaggacagatgggcaactctgaggtgggccatcttaacatgggggcaggccgcattgtttaccaggaactgaccaggatcaccaagtccatccaggacggtgattttttccaggtgcctgaattccttaccgcggtggaaaactgcaagaagaacggcactgcccttcatatgttcggccttgtgtccgacggaggtgtccacagccacaacacccatatctacggccttctggaactggctaagaggaatggccttgacaaggtgtatgtacactgtttccttgacggccgcgacacccctccggaatccggcaagggattcgtagctgatctggaagccaagatgaaggaaatcggcgtgggcgaagtggcatccgttatgggacgttactatgccatggaccgtgacaagagatgggaccgtgtggagctggcttacaatgcgctgacaaagggcgagggaaaccgggccgcaagcgctaccggaggaatccaggcatcctatgatgatggcaaggcagacgagttcgtgatacctttcgtggttgaaaaggacggtaagccaaccgccaccattaaggacggggattccgtgatattctacaacttccgcccggaccgcgcaagggaaatcacccgcgcattctgcgatacgtcctttgacggttttgcaagggataagaagctggaccttgtgttcgtatgctttaccgattatgatgaaaccattgaaaacaagctggttgcattcaggaaggagagcatcaccaacaccttcggcgaattcctggcagcccatggcaagacccaggtaaggattgccgagactgagaagtatgcccacgttaccttcttctttaacggcggtgtggaggaacctaacaaaggcgaggaccgtattctggttccctcaccaaaggaagttgccacctacgacttaaagcctgagatgagcgccaacggcgtgtgcgataagctggtggaagccatcagattaggcaagtatgatgtaatcatcatcaactttgccaacccggacatggttggacatacaggcgtggaggatgctgccatcaaggccatcgagacagtggatgcctgcgtgggccgtgcagtggatgccatcaaggaagtggacggcgtcatgttcatctgtgccgaccacggcaacgcggagcagctggtggactatgaaacaggggagccatttacggcccacaccaccaaccctgtcccgttcatcctggtgaatgcggacccagcctacaagctgcgcgagggaggcgccctgtgcgatatcatcccaaccctcattgagctgatgggaatggagcagcctgtggagatgacaggaaagtccctgctggtgaagtaaggtttgattggagtttaatggattgtaatgtatgagaaggccgggcggccgtgactgcccggtctttttttgcgccccaatcacaaaatacacacaccaatctaaaaatagggcacttgtgccgatacgctcccctgccatataatgagaggaggagaaaacatctggaggtgcctgtcatatgaaacggctggaaaaattctttaatatgaaaatgattcggaaccgtataatcgccgtacagctgggggtcatcattccggctgttatcctgctgggggtaatgatatacggcatgacaagcgccatgctcataaagacaaactcggaatcctatctaaaggtccttgaatcagcagatatcattttgagccattatctggattcctaccgtgacattgccaggaacgtgctggcagacccggttcttcaaaatgaccttacgataagcagcaattcccggtcaggtggaagacggatagaagagcgcctgttcgtggatctggacaatgcgatggaaaagtatatcatgggattttccggcgccaggtccatctatctgtatgattccaggggaaggctgttctatctggatgattcaggtcagggcaggtctgcggcagacgcagcggactatggtgttatctcagccacgccatggtttaagaaggcggcggcgcaaaaaggatatgaggggttcgcgggccggaatgtaattaccgggaacagggagcagttttcctgcatcaagctccttaagaacctcgatacccaggatgtgattggaatgatgatattgaactttgacaaagcggccttaaaagaggtatttccctcttaccgcccagagcagggcgcatatgctgtggtggaacaacaggaggaggggggatatgatgtggtcctgtcatccggcgcagccatggaggagcaggagattgcccgcatactggtaaagggggacccggactatcatctgtccaggtatggcagctcggaaatggactgggagctggtacacatggtgcagaaccggaacctgttaagtgaagcaggtaagatacagggcattattatgaatgggctggcgataaccattgtccttctgctggtgctgacggttcttttgtgtaaccggatcacaaagcccctttaccagctgagggatgacattgtacgtgtgggggaaggggaacgctgcctggaaacagattttccggatgacgagattggcgccatcggccaggaattcagccgtatggtaaatgaaaagcttaccctggccgaccaggtcacacgggtggagcttaagaataaggaggcggaactggagctgcttcagtccaacatcaatccccacttcctgtataataccctggattccctttactggatggccatcctccatgaggccgaggatgtggcggagcttacaaaggcattgagcgatgtgtttaagattgccctcagcaaaggggaaaagttcattcccatacagaaggagctggattttgtcagaagctatctctatatccagaacatccgttttgaagggaagatccatgtggacatccaggccgatgaaagcctgatgggatataaagtcataaagctgctgcttcagccatttgtggaaaatgctgtttaccatgggctggagcctaagctgggaagcggcaccgttgtcataaaggtttacagggagcaggatttcctgtgttttgaagtggcggatgacggggttggcatggatgtggatgcttccctttccaaaggatacgccctgagaaacagtctggaacgcatccgtcttgtctatggtgatgatgcaaaggtggaatttaagagcagccccggacagggggtacaggtgaaaatatcgttgcgggcgggggtaaaggaatgataaaagtggttctgattgaagatgaaaacgtagtcttaaaaggcatggccatggtattgaagcgggagccggatgtggaactggcaggcacggcagaagatgggaaccagggattggagctgatatacagggaacatcccgatgtggtcctgacggatatccgcatgccgggactgtcgggcctggagatgatagaacaggcccagatgcgttttccggacacggtgttcatcatattcagcggattttgcgagtttaaatatgtccagcaggccattggcctgggcgtgcttgcctatctggaaaagccggtgacggtcagcgatttgcggggcgcccttaaaaaggccgccaacctggtggactacaagaaaaattatatacgcatgaaggagcgcacccagcaggtaaaccgggtcatggtggagcaggccctgtacgacctgatgaaccagccgtccgccatggaagctgcaaacatggagcggcttctggaggtgggggaatatcttagcttttcaactgagctggccgtgttatgcgccgggaaattatcctggaaggagtctggcgtggatgaataccggaaactgatcaatgcaatgacattttcaattgcagggaaccacagcctggatatttacaccctgaccgtggaggagcagctgtattttgtatacttcaaccaggaatgccagatatttcccttttatcaggagatatccgggcaaaggcaggcgctggaggaccagggcatatccttttatgggggaatcagcagcatacatcagggcatctatgggctgaaggacgcgttttcagaggccaggagcgcccagaactatgcgtgcttcctggaagcggaggagattgtgcgcagcgaggatgtggagtatcggaaccatattccggcggagattacggacagccagtattccatggagtttaatttccgtctgcagaattacagccagttcaggaaacaggccggggcatacctgtcctacctggctaaggcgggaatcatgccggagcttctgaggaacgaatgcctggacctggtatacctggtacaaaaactttcgctggaatccggtggtgttggggaagataggctgcccgtcatcagccacagtgaaatcatggacctggaatccgcggaggaaatgacggactgggcgcgccgcatgacggatcgtttcctgctggaggtggagcaggaccagaatacggaaagggaacaccctgtaagcgtggtgaaaaaatacatagaccagcattatgctgagagcatcacgctggaaaccctggcggaccaggtccatatgaaccccacatatctgagcgtcctgtttaaaaaggaagagggggttgcctacagccattatctggcccaggtccgcatccgccaggcggcagggctgctggaaaagggggaaaaggcaaaggatgtgtgcaggaaggtgggatatttcgactaccgctactttaacaagcagtttaaaaaatatgtgggcatgacaccggacacctataagcgtacaaagatagggcttgaataaaagagattcttgaaaatggcccaacaatccaaaataaaggcggatttaaaaaattaccggctcaccttacaatggaaccataaaacacagaggagagtcgggacatgaaaattcaaaacttagattacacagatgcaggcttaatgatgtctgccctcagggaaacagtggattatatcaggagccggacaagaaaggtacctgagattgccatgatcttaggttccgggcttggggattacgcgtcccagctggaaaatgccgatatcattccttatgaggacatccctaatttcccaaaaccgacggtcagcggacacagcggccggttattcgtgggggaaatcgcaggaaaatgcattgccgtgatgcagggaaggaaccattattacgaggggtatgacacccagacaatcacttatcttgtcagggtactgcgcatgctgggggcaggcagccttattctcaccaatgcctgcggggccgtgagcagacatttcgtcccgggggacctgatgatcatcgagaatcatctggcacacttctgcccgccgcccctgaggggagcacacctggaggaactgggaccgagatttaccgatatgagcaggccctatgacccggagtacatggaactggcccgcagatgtgcaaaggatatgggaatcaggatacagcagggcgtgtacggttactggcccggccccacctatgagactgccgcggaggtccgcgcatatggagtcctgggggccgacgtggtgggaatgtccaccgtggcggaggatatggtggctgtcaactgcggaatgagggtattgggcatttcgtgcataaccaacatgacatgcatccattcctcaggtaagaccagccacgatgaagtcatccaggtcatggagcagatatctgagaagaccgtgaaattgctgaaccggattgtagaggaaatgtaggcgcacaggtgataaggaggagaaggataatgagaagcaggcagatgatttcagtgttgttggccgcagtgattgcactttcaagcgtgggatgttccggcgccccctcatccgggaccggttcttccggctccggcagcccttcggggacagaggccggacagactgaacagggtggacaggccggacaggatggggaaaaggtagggaatggtaaaacagatacaaaggaacggaccattacctggatgaccgtgcgttcctcatggcctgccatgaacatgattgctgaagattatatgaaggaaaacccggatgtaaaagtggagtttgaggtgatttccgaccgttccacctataaccagaagctgaagatcctggctgccagcaacgaactgccggatctgtttgacagcgagggggataccctgctcagtgagattgcctctaccggggccttggtggatgtggacggcctgtataaagacctgggctatgaccgcatgatgaacattggggaaaactatgcgcgtctgtccgacggtaaactctacagccttgcatgggagaacaacattgaatatttctggtaccacaaggatttattcaaaaaggccggaatccagaagacgccggagacctttgatgaattactggatacctgccagcagctaaaggatgccgggatcacacccatctccacgtggccgggctgggccctgttacgctggatggcttttatcccctaccgcctggagggcaatgattacattgagaagctgaaggtgggggaggcgaagatgggtgaccccgtgggcatccaggcggccaatttcttccagaagctgggtacggaatatttccagcccggttggtccaccagcgactataccagcgcccttgagaatttcctttcaggaaatgctgcaatctattacatcggtacctggcagttcagcagtttcatggatgaaaacagggaactgaaagacgattacgcatatttctatatgccttccatggaaggagcggtgaatggcaggaccgatatgtgggccaatgcaggcacaggcacgtccatcagtaaggataaatatgacgaccagttaaaggattttatcaaatatgtgctggacagttatcctgaaactgcattttataagaccagcgtcatgccgcccatggattttgacaccacgctgggaaccttctcggactttgaccagaaggtcatggatgactgcaacaacctgacagattacggatacagctgggatgtgcgcatggactctgccacggttgaggtgatgaataaggagattgtcaacctgggtatgggcgccataacgcctgaggaatttgcacagcgcattgacgccgctattgctgaaaatgcccccaagttctttcaatgacctggcagaccttagggcctgtttgaaaattcattcccgccatctgcacgccccacttcgcggcatatttggtcccaattcggtcaacgtagcccgctacgcctccctcatcgggaccaaatctcccacaaagtgggacgcacagctgacggaaagcaattttcaaacacgccctagaatgaggaggattccacatgtgtctacaccgaaaacaggatccatacattttccttgccctgcccctcatcgtatatcttgcagtggtcctgattcccatattttcatccatatattacagtgtcatggactggaacggtattacggaaatgaagtttgtgggaataaggaactacgccaagatgttcaaggacccaaacctgcccacctgcctgtttaacagcctgaaatatgctgccgtcggcaccatattccaggtgggcggaggccttatcctggccatcctggtccagcagatacgcaagggacagaatatcaccagggtaatcctgtttaccccggtggtcatatccggtatggccatgagccagacctttaagaaattattagccatcagcccggacggcgtggtcaatgcgtttctgggagcggtcgggttgtcacatctgaaaaccgcgttcctggcagacatggacctgaccttgtgggtggtggcaatcgccgaggcataccgtttctggggactgtacatggtggtgttccactcagcgtttacctccattgacagcgaggtcattgaggcggcttccattgatggggccggatactggaagacactgctctatgtccggctgcccctgatccgcccggttatcatcaactgtatcgtattggcggtcattggcaccttaaaggcatttgaaggtccgtttgtcctgaccaacggaggtccgggatatgccagcgagctgatggcaacctatatgtataagacggcatttaacaacatggaatatggatacggcagtgcgctgagcctgattattgtagtggaatgtattgcgattttcggacttatcaatgccctgacaaagcggaaggagtgagaaggagcatgaaaaacataaaatccctgaaacggctgcccctttactgcctgatcctgcttgtggcggttatacagacttatcccatcctgtggattttcctgtccagcatcaagccttcacaggagcatctgatgaacccgccctatgccctgccaacagcgcctacgcttgccaactatgtaagccttctggattccatgatacccacctattttaagaacagcgtggtagtggcagccataacccttacaggaatcgtggtgctgggggcgctggcagcatatcctttatccaaaatgcagtttaggggacgtaccctggtgcgcaacttcttcatgctgggcatcatgattcccatttttgtatccctggtccccatgttcgggctatacaacaggctggggcttaagaatacatactggtccctgataataccccaggtagggtttgccatacccatggccatgtacctctatattggctttttggaccagataccggacgcccttattgaggcggcctatatggacggcgccggttccttccgtatattcctggaaatcattgtgccccttctgcataatgccattgcaaccattgccatatttgagtttgtatttgtgtggaacgagtttacattcgcaaatacgttcatcagtaccagcgcaatgaaaacagtcccggtaggactgaatgatttcatcaataatttcggcctgagggactgggggcttacctttgcggctgtatccgtgacagtactgcccacactgatagtattctttatattaaataagcaggtaatggcaggaatgactgccggagccgtgaaaagttaactttacatgagaaaggaaatagcagatgtccagtaaattatatatacagaacaggatttataatgtaaatgaccgcctgattgcccttgatttatacgaaagaatcattgattggatagacaaggggcttctggctgatatgaaagagccataccttccttttaagagcaccaacaataccagcgttgaccaggaggcgggaatatttgaaatggatgtgcaggccctggctgactgcagcggggtggtggggtattttgacggatggacctatgacccgggctgtgggtttgaaattggctgtgggtacgcatggggatatccggtcaacatcatctccacggatattttcaccagttcggtgggggattcacaggatttttaccatgcaagcagactggtggagcatatttcaaattttgcggctgtttcggatctgaatcaggagataacggattacaggcagaggaacatggatgtgctggaacgggccctgacagtttttaaaaacaatctgatccgcgatttcgggacgcccagaccggcccctgtacccattcagtccttgccggtggagtatgactattacctggatcctaattttaaatatacggaatccggacagatgctgcttgagaaaatcaaatcagcaatccaggcagcaggaaagacctgtgtgacaggggacaaccagggcgatatagaggaggatattgaccgcctgagaaaaagcggccaggccatcctgctatttgatgcggcggaacccaatattgactcagccgtccttggggggattgcatatggaatcggccggaaacccattgtatactccagcaataagcagcggatccatatgtcaggcaggtttgtgtgccagcttaacagcatgaactgttattcggctgagaaggtggtggaatccttggaggaacttgtgaaggtgattggggaatagttgcggggaatctacgtgatagctatgcggatagccatgtggatggatatatttctgaaaagacggatttctgaaaagacggtcaggtattgcctggtcgtttttttgttatcatcggtatggtatcacttttaaaatcagcggttattaaagttgattctatcatttgacttctatgatatacttgatttataaaatatgcttgtctgaactgccgcttaaccagaagcatggagacatcaaaaaagaatgggtcactgatgatacagcagttagtataggatgattctatggatgataaaataaaatcaatgattgatgaatatatagccaaggtagaggatgtatgctgcaaactactggaaggaataaacaggcaggaaaacctggaattaagaacgaaatgggatttctttgaatacaggggaaaagtgcgtaaaaccgtgttcatcatcggtggtaccacatacagacttcatgggaacggctgctttgcttttggcgatgggctgtatttggattggaattttggttacagaagcagatggtgcggtattgatcccaggatactggggatgaccctcaagcagggagggagcagccaaacggaatatttcgatggcaaattattggaagaagcttgtgagctggctgtcattgaaggcgaaatgtttaaaaagaacggactctatcattatgcggtgaataaaaaggatacatttacgccggagttcccaaaggaatatgacactttgacaatagagtattttcgtgaaacgtggatacttccaagaagtaagatgacggataggtttttgagaaaaagtaattggatttgtaatcagatatacggcaatcaaaatagatatgttttacggttctttctaggagaaaacgaaatatattcagttccatatgatgacatgaactatccggagaatgcggttaaaatcatgacagacaccattctctggaatttgaagaagcagggatagggattgtgcagattaaggagggctttgcatatgtccaggggggatgaccaatattatcgtggttatgaaggtgagccggaaatcgggttttacacaataaaggaaaaaatagttatttgggcaggcttttttgacgatataatggagcagatgaaaccatcccggtatggatggactggaattgcatactactatcatttacataccggatggtatgatgaagacttttggcagattccagacttagaagaatgtctgcggcagttcgaaggaataaatatatctgaatgccggtttgaagggtctaaaaatgtgttagcatccatccggagcatgctttcattggccatacaggaaaatgaaaacgtatggatatcggagggatgacaaccgatgagcagaccatgcaccaccaggttttgctgcaggtttatgacaattggttaaggagggaccgatgcctattactgcaggcatattgttggctgatgaataggaggactgttccataggttattaatttcctatggaacggtccctctgattataggctttaacctgttgggtatgtcggggtttttcgcgtttcaaaaaatggagacatacaaaactgaaaaccctccgctctcccttagcctacctgtaatgggaaaaatagtcaaactgattcaaaagaatcgtaaggcgaagcccgataatactgtcaagattagagaagctgacatgaatcaggttctctatttttgcaatcctggcatggagggtgtttacgtggatgaataatttttcacttgttattttataggaaagctcattggagaaaaagtattccagggtaatatataaatccgaggaatgctttttgtcgtaatccacaatgggctttaaataggagtgatataattcattgaggtaggcatcattgatattgccgttgctgtcagtgaacagtttgatgattcccaattccccgtataccaggagacacacattctcctgtttgttttttgcgtaattaatcgtaaaagcagcttcattaaaggcccttcgcagatcccagtaatggtggaggtcactgatacccataatgaaatgggaagtattaaaataggtggaaagggcatcgtataactgtgcgcccatggccttgatggaaggcaccttgtcatccatcaggatgacccactgttccttatataaaaagaccagaaatttatcattgtatagtttgatatgttttaaatggttcataaatccggtcagcagttccacattgttaaagatatttaagtccttccggctgttaattaaaagcaggtaatagttaccgctgagttctgtgttcaggctcaggccaatctgctttttgcgggcgcggtcctcatgggacatatccaggagactttcaaaaacaacacttttaaaataataatttgatttctcgaattcagcggtaatgctgtttttcaaagaatagatggattcgatggtctccagccggcagattaactccgggggcagtgtctctgcaaaaaagcggtattttacaatgataaaaaacgcggaggtaaactttgaaatatgggagggaatgataaaatactgatactccctgttaatggctgtgtcctggtatctgtatccattcattgtgacgccgttaaagttctcaccaatgggaatgcggtggtgcagggcgctgattctcaggttatacagttccgtgttccagttattgtcgtttgagctgtcctgcagccgcaggttatagtccgcaatggcgatggtaatctgtgtcaggttgtgtacgatttcacacaggctgttgagggtatagtttttggacaggtaattgatgatggaattctggaaattctggttctcaacaagatactgcgtctgattgttgatgaccagattctgaatcaggacaatcatgtcacgccatggaacattgtcctctataaatataagaggaatgtgatagttcatcaataagtttttctgttccgtggttatatattcttcatacagcttatgtgtgatgacacctgaaatttttttctggtgcagggtattgatgaatttctcggtgaggcaggtgcgcataaagcggcttataatcaggatatcaccttcatggagccagtcgtcaatatcctccacatccatgacggttgcgctttttatgacacgctgaagtccctgttccgttatgaccgtatcacaggaatacatttgttttgtattgagaagatcccttatggaaacttccttaaaatcgttgtgaaacgtatactttaatgaattatctcccatcatatccaccgccttatatgagattatatcattgttccctgaacatgcaaagatgataatttaaacttaaagtgaaaaggccgaaaaatgaattggttatacatacaaaaatagaagtataattttgtatgtatacacaatagaaaaaacagtattaacagattatacttgttttaaaaatcagacctcccaatggggcagaacatggaatcatcacataggagaatcgatatggagagccaaggcaacagaacgtatactttaaaggagttatgcagatttcttatcccgtcggttttgggaacggtaatctttctgcttccaatccagtggcaggggaatatgaccatattcattggcatcattacggatatgatgcaaaagctgttagctcctgtgattacggctatggtggtagccgccattgtactgtcggcagtatgctctaccgtcaggcgtttcctgaagccggcctgtattgtggaaagtgaacgctggaacagccttttttcctgtaatacgttctattatgtatgccgcctcctgggagcggtattcgcggtcatggtttactttggggttggctttcatattgtgatttcaccggatacaggagggaccatgctgaatctgctgaagaccattaccgtgtggtttatggcagcggcatttctgattccgctgctgacggattttgggattatggactatgttggcacgatgctgcgcaaggtgaccaggccggtattccgtttgccgggaagggcggcggtggatctgctggcctcatggctggggagcaatacagtgggagcggtcctcaccattaagcagtatgagcgcggatactacacggccagagaggcggttgtaatcgcgtgctgcttttctgcggtatccctgcccttcagcctggtgattgctgccatgattggggtggatcatttgtttgttcccttttatctcattgtcacaattaccggaactgtgagcgcggcaattatgattcggattccgccccttcgtctgtatccggacgagttctgcccggatgtgggaaaacaggtgaaagaggaagaactggaaggctacaccatgcgccaatgggccctgaagctggcggttgagaaagcggcaaaggggcctggactgaaacagatcctaatcagcgggctggacacatttatgggaattgtgttccagacagcgcctatcgtaatggccttcggtaccatagcctgtgtagtggaggtttatactccggtgtttaaatggctgtctattccctttggattctatctgcagttacttgggattgaggatgccttttctgtggcccctgcagccatcatagggtttatcgatatgttccttccctccattctgctggcaggagtggggagtttaaaaacgaggtttgtattgggcgcattgtcgctggtccagattatatacatcactgaaatcggttctatcctgatttcctctaaggtgccaatcagattgaaggatctctgctatatattcatagagaagacagtgctggcattgccaatcatcattttgctgaccaaaatgttccgattagtttaaggcggggttattgtggtggaggaataccagaaatgcgccgcccgggaaatgaatctgtatgggattataagatgggactgttgccttgacagtctcatttttttcggattcccatattggtgattcatacattcttttaatcgtgactttgtgtatcccgccaatgtatttccgggcctgtttccactaaaataaaatcacgcaatacggtaatggtaagtgcaaacaaaaagaagaggaaggtgaattaaaaatgggaggaacccaaaagaaaaaaaaggaaaggaaggggctgaattcgtacgttgtcgtatttgcagtcatagtgctgatggcccttctgacctggtttatacctggcggggaatacgaattggacgaagcgggttatgcaattgcaggaacgtacaaagaactgccggccaatccccagggactgtgggatgtaatcacggcaccaatcacgggtatggttggaaatggagccgtcagcggagctatttccatttccctttacatcatgcttttcggaagtttcctgaagatgatggaagagacaggtgtgattggatatgcgctgacatccgtggcaaagaagtttcaggaaaaaccctatgttctgataacaatcttggtgtttatcctgtcattccttggcacatcccagggagcatatgaggaatgtgcgatttatgtatccctattcctgcccatattcctggccctgggcatggatacgattacggttgtgatgatttccgtatttggtacccagattggctgtgcggcatctgcaatcaaccccttttccacaggtattgcttcggatattgcaggaatatcctttggagacggaattattcccagattaatcctattctttgtactgtcaggtacggttgcggccctaatcagcctatatgcaaaaaaggtccaggccaatccggaaaaatccatacagttttaccgacggaaagaggatttggaagcttttgtaaattctgaggaaaacagcggcgcatctgacaatgtaaagcatatgaaaggacttttaattgtatttatcctaacctttgtcatcatgctgctggcattattcccatggacttccatcaatgagaatttcacattctttacatccgttgcaaagtggatcaatacaacccccattatcagcactgtaatcggaagcaatgtggtggcattcggtgactggtactttacggaactgacagcccttatgatggtgatgtgtctgattgcaggctttatggccggatatgatttggacaggatcatcaacattatcatcaaaggagcagcagagcttgtgtcaacagccctgattgtcccaatggcgcgcggcatacaggtaatcatgacatctggaaatatcacatccaccatccttcatgcaacagaagtgacgcttggctccctgccggtggtgattttcgtgttcctggcatttgttatctatctgatatttgcctgctttcttcccagctccacgggacttgccggagccaccatttcggttatggtgccccttggcacatttgcaggagtaccgccctatgtgatgataatcatctataactttgctcttggcattgccaagatgtttacgccaacctccattgcggtcatgacctgtacgcaatacgcgaagattgattatatgtcgtgggtcaaagctgtctggaaaccgctggttgtaatctttttggtgtgtctggcatttgcactgggactgacactgatggggtaaggcttcattgccgggaggaaagatatgaagatattgattgcagattatgcagaacttttaatgcccgcacatgatttggaaacccaagtcttaaaagacgggctgggaacagattgtgaggtggaggtatacaggtacgcggatgaaaagcgggatgaattttatggaaggctttcagggacggacgccctgctcaccggttttattgagatggatgcagaagccatggaccatgcccccaacctgaaggtgatatccattaatgcaaccggttatgacaaggtagatctggctgaggcaaaccgccgtcatattggagtatgcccggtgggggagtactgtaccattgacgttgcggagcatacaatctgcgtcatgcttgcattgattaaaaatctgaaacattacatacacgcactggagcgtgaccacaattgggactatcagattgtggagcctaataaaagaaccaagaatatgacactcggcatctttggcctgggaaagattggaacagcggttgcgctgcgcgcacaggccctggggatgcgtgtcatggcctatgacagatacgtaagtcccacatacgcggaagactttggggtaaagctggtggattgtccggaggacatatatgaggaggcggatgtaatctcaaatcacatgagcctgacagagggcagccacgattttttcaacatggatgcattccgcaggatgaaaagacatccctattttctaaacgcgggccggggtgcttcggtggtggaagaggatttgaagcaggcccttgatgaggagctgataaaaggcgcggcccttgacaccatccgggatgagaggccggaacatatcgcacggaacccactccttggaagggatgatgtcatcatgacgccccacaccgcgttttattccacctcctcggtggaagacctggaacggacgtccgcaaagaatattgtgcactatctaaatggagatttggataaagtattcaaactggttacaaagtggtagttaacactgaaaaaatactggataaaaactgaaaaaagagaaaggagacaagaaaaaatggcaatatcattaaaaggaagaaacttttttgcactggaggattttacaccggaggaaatccgctaccttctggacctggcaatccggctgaaaaaggagagcagggaacatatcagacatcaggactatattggggaggacttcctgctgttgtttgagatgaactccacacgtacacgatgtgcatttgagacatctgcaaatgatttggggatggggaccacattcttatccaattcccattttgggaacacggaaaccatcaaggattccatgagggtatttagcgagatgtacagtgccattggatatagaggggccaaacacagcacactgttagagatggcaaaagacagcacgattcctattatcaatggatacacagaccatcagcaccccactcagatgctggcagatgccatgaccctggatgaagtctggggacgtgaaaattataagggaaagaccttgtgttttatcggacggggcggcgccgtgaactccttctcatatggtgttatgtgtgctatgctggggatgaactttacttacattacgtcatacatagaaatggatgaggcattagagggactgacagcggcagagagggctaccttccgcaggtttgtacccgagggtgtggtatcccctaattggaatacgaaaatggaagccagaaaacgtaagattgtggaagacttgtttgcaaaatacagtcctgagtgtaaatttattgaaactgatgatatcaacgccataaagggagtggacgtaatcaccacagaaaactggggattcttcacggaccctgttgagacatggcttcctggaatcgtacgttttcgtccgtaccaggtgaacagggaattgttgaagcgcacagaaaacccggattgttttgtgattcacatgctgccctccacccataatatggaccatgcatcaggccagaagctgctgtctgttatcgaggatccggatttgcgggagttccttaagggggggatggaagtgacggacgaagtctttgagcagaacgcggcatatattttccaggaagcaggaaacagaaaacatagcattaaggctgttataaaagcagtgttaggtgagagatagaggaggaaccggttatggatatattaaaatatagaggattggattacagtgattttagggtaccgggagaatttgaaccccaggaatatgtaatcctgggatggccggcaatggcagagtgcattaaaggatacagtctgcacaaagcatttgcccagttaatcaaaatcatagtggagcaggcggaaggcgtgaccgtgtatgtaaactgcccggatcaggcgcgcgtggaaagctgcaaaaaggcattggcagaggaagatgtggatattaatcaggtggtaatcaccacttatccggacggcagcaactggacaagggattacggtcctgacatactggtggatgacaaaggccaccgtctcctggctaacccaaggtttaacatgtacggacagagcacgattgacagtgtgacttccactctctgcgcaaaatttgctccccatcttgctcttgagattggctgcagggatttcctcaattccacattaatcaccgaaggcggggacaaggaatttaacggaaacggtgtgttgatggctttgcgggataccgaagtgaccaagaggaatccccacatgtccacggaagaagtagaggaggagttaaagcggctgtttaacttaaagaaggtgctctggctggagaagggtgtttttgacgatgaactgaccacctcgggtgtgttggattatgtggacggggaaccggtttaccgctcttcttccgccaacggccatatggacgagtttgccagatttgtgggatccaataccatcctcctcaccgaaatcacagacgaggaggcggctaagctgaattcacaccgcatcacaaaagagcgctgcgatgccgcatacgaggttctgaaaaatgcaacagacgcagaaggcaatccatataagattgtgcgtatgcctgcgccggaacccttctacgtatattccaaaccgggtgactggattaatgatacatggtcctgccgctatggggaaggaaatgacttcctggatgacggaacccccatgcccacaggagatatgattatgcagcccgccttaagctacgttaatttcctaatcctaaacaacattgtgattgcgcagaattactgggaagagggcaggccggaaagcatcagggaacgggataagaaggcccttgctgtcttgcaggaggtatttcccgataggaagatcgtgccatttataagtactgccctgaatatccgcggcggtggtgtgcactgcgctacaaagaatgtgggaaaggcatccaaataggttgaatgagacaaaagaggtgagaccatgtcaaaaatagtaatcgccctgggcgggaacgcccttcagtccaagaacagtaagccgacttcagagggccagctggaggtggtaaggcatacatgcgggagactggctgaaatcagtgcgcagggctatgagatgagcattgtccatggcaatggaccacaggtgggaagaatccttttggccttcgaggctgctaaggatgtgacgcctgtcatgccctttgatgtgtgcggcgctatgagccaggggtatattggataccatattcaacaggcattaaagtatgcgctcagtgtcaggaataagcattgcccggttgtgaccgttgccacgcagattgtggttgacaaagacgataaggcatttgaaaatcctacaaaacccatcggccctttttacacagaggcagaagcaaagaagctgatacaggaaaagggatacgtcatgaaggaggatgcgggaaggggatggcgcagggtggttgcctcccccgctccccgcaagattatggagatagatgcaatcaagaacctttggaaatcgacaatcgtggtttcctgcggaggaggcggcatcccggtagtggagaatcctgacgggacattagaaggagtggctgccgtgattgacaaggattttgcggcggaactactggcagagcaggtggatgcggatatcatgatgattctgaccgaggtggaaaaggttgctgttaactggggccggccggatcagaggaaccttaacaacatgagcctgaaggaggcggcccggtatgtggaggaagggcagttcgccccgggcagcatgcttcccaaggtagaggcgtgtatgaagtttgtgcgccagaacccgcagaaaaaagccatcatcaccagcctggataaagcattggaggccctggaaggtaagaccgggacagtgattacgttcgcgtaaggtcatcagggtgtgatgagataggcaggatacataaaagtaataagaataaggcgctctaagcctgcctgtgaggtacaaaggccgtatcgcaggggtaggtttgggacgccttttttgatgatgttaaacaaccgcatgccgggcctgggctgataccatttcatctgtctgtccattgctgttttcaacggcgcccttccctgtatccgccgccagttttttcgctgttttttccaccgctttccccgccgccttctccggtatacttcctgacagcttaatcgccgccttggaacaggccgggcctaccatttcatagagcaggccgctggacaggatgatggtggacagcatgaggccgctttcagttggcagcatgcgctggcccaggacagccaggccgatggaaacgcctgcctggggaatcagggccaggccgaagtaacggcggatttccggtgatgcgtggatgatggcggcgcccatgctggagcctgcgtatttgcctgcaatccgcaccaggaaatagatgaccccgatgacgccggcagcagccaggctggggatggccagccgcatgccggaaagcacgaagaacatcaccagcagcggaggcgtaaactggttcagctgcttaaacagatgtttgttgccgctggcattgacatatgccgtgccggaggccatgcaggccaggaggggggatacgttcatggaagtgcatatgccggccacgcccatgatggtgacacaggccaggacaaggctgtggtccttactgcgccgtttgtgtatgagcctgctgagcatgatgccggatacagcgccaatggccagggcggccacattgaacagcacgggcaatgcaatctgtgataccgtgacagaaccggttccggagttggcctgcacaaaggcagcgcagacgctgaaagccaccagggccactgcgtcgtccagggcaaccacctgtaggatggtgtcgatgaacggaccctttgccttgtactggcggatggtcatgatggtggaggccggagcggtggcgcagccaatggccccaaggagcaggctgaaggacagggacaggcctaaaagcagcatggcagtggtgatgaacacgcctgctgtcagggattcaaacagggtcagtatgaccatgttctttccgttggctttcagggatgaaagcttgaagtatttgcccaccccaaaggcgatgaaggccagggccaggtccgtgacaaaatccatctggccgatatattcagaaggaaccagattcaggcaccatggcccgatgatgactcctgcaataatataacccgtaacgttgggcaggtgaagcctctttgtgatgcgtgtaagcagaaagccggatgccagcatgattgcgatactgagtatgattcctgctgctcccagatttgataaaaacagtgccatatggaacactcctttctgcggacagggcataaggaattaccctgttccttttttgttttgcttgattatagtagcatttggtgataaaatcaaatgatattaattaactggtatataaaatttatttatattgtgaaggagatggtatcgtgttcgatgcaaaggtgaaaaccctgctgtccgtcatcgagacaggaagctatacaaaagcagcagaaaagctgaatctgacccagcccgcggtaagccatcagatacggatgctggagaatgaattcgacataaaaatcttttatagggataaaaacaagctgaaactgacacctcagggcaagattctggtacagtatgcacgcagggcagcagctgtgtatgccaatgcatgccaggccatcgaggacagcaaatcggagaccagacacctgaacgtggggattacccccacggcaggggagaccatcatcccccaggtactggctacgctctgcaacgagaacccgggcatccatataaatatcggtgtgaataccattcaaaaaatttatacccggctcaaggcatatgagcttgactttgccgtggtggaaggcgctgtgccggacgcggccctggtgaccaccaccctggatacggattatctgtgcctggccgtatcccctatccacaggctggccagggccaagactgtctccatccgtgaaatccgccatgagaagctgattttaagaagccagagtgcgggtaccaggcagctgtttgaaaagcatcttggggccaggaacctgagcctctctgaatttaatgttatgatggaactggataatgtgtccatgattaaggaactggtcagcatggacctggggataacaatcatcgcaaaaagcgcgtgccgtgaggaactggcaagcggccgcctgtccatcatccccattgagaattctaccatggtccggcagattgacatggtctaccagaaggatttcatccacccggaacttatagagaacatacgcaggatatatgaagagctgaaggcaaaatagcccttccatttttatgggaaataggatagaatggatgatagtgatttgctgaaaatgatttaacaggagtaatgtgattgtgagtggaaaaaaaggcatgaggacagggaaactgcttaggagtttccttccctattatggaaggtataaaaaaatattggttttcgacctggtgtgcgcggccctgaccacactgggggagctggtgttgcctctgatgctgcgctatatcaccaatcaggggatgcaggacctggcggccctgaccacagggattgtggtcaggataggaatgctttacctggtcctgcgtatcattgattccctggcggcttactatatggcttacaccggccatgtgatgggcgtgtatattgagacggacatgcgtcaggatgcatttgaacatcttcagatgctttcggacagttattacagcaacacgaaggtggggcagatcatgtcccgtataaccagcgatctttttgatgtcacggaattcgcccaccactgtcctgaggagttttttatcgcggccctgaagacagtggtttcattcatcatactttcaggcattaacctggaacttaccttgctgatatttgtactgataccggttatgatcgtgtcctgcacatggttcaacatgaaggtgaaagaggcattccgcaggcagcgcaaccagattggcgagcttaatgcccagattgaggatacccttcttggcaaccgggtggtcagggcatttgccaacgagccggtggagattgagaagtttggaaaaggcaatgaagccttcatgaatattaagaaatacacctaccgttacatggctgcgttccagattacaaccaggtcctttgacgggctgatgtatgtggttgtcattgtggccgggggcattttcatgatacagggtaaggtggagccgggggatctcgtggcttataccatgtatgtgaccaccctgctgaccaccatccgcaggattattgaatttgccgagcagttccagagaggaatgacggggattgaacgtttccaggaaatcatggacgttgtgccggatatcagggacaggaaggatgccgggaacctggaaggaatcaaaggcgccattacctttgaccatgtaagctttgagtatccggacgaccatgtgccggttttggaagacatcaacctgcttgtgaagcccggggagcgcattgcgcttgtggggccttcgggaggcggcaagacaacgctctgcaaccttctgcccaggttttatgataccacaacggggagcatttccattgacggacatgatatccggggcgtaaccctgaaaagcctgcgctccaacatcggtgtggtccagcaggatgtgtatctgttttcagggtctgtttttgagaatatcagctatggacggccgggggcaaccaggcaggaagtggtggaggcagccaagctggctggcgcccatgaattcatatcagagcttcaggacgggtatgacacctatgtgggtgagcgcggtgttaagctgtcaggaggacagaagcagcgcatcagtattgccagggtattccttaagaacccggccatcctgatcctggacgaggcaacctcggcccttgacaatgaaagtgaatacctggtgtcccagtccctggagaagctggccaagggccgtacgaccattaccatagcacaccgtcttaccaccatacagggggcggacaggattcttgtgctgtccggcagcaggattgtggaggaggggaaccatgaggaacttctctccaaaaaggggatgtactatcagctgtatacaacagccaaccgtttgaaccagggaattgcatagaggagattttaaggagaattcattatatgaagatagctattgttgctgacagcaacagcgggattacgcaggatgaggcaaaggaactgggggtatccgtcctccccatgccttttatgattgacgggactgtttattatgagggaattgacttaagtcatgaggagttttacaaaaagatggaggaaggggctgacatcaccacctcacagccatcccccaaggatgtgctggaatgctgggactcccttttggaggaatatgaccaggttgtctatattcccatgtccagcgggctcagcggctcctgccagaccgcccttatgctggcagaggattacgacggaagggtgcaggtggtgaataaccagcgcatttccgtaacccagcgccagtctgccctggatgccaaggacctggcggcaaaaggatactgtgcagaagagataaaggatatattggaagcaaccaggtttgacagcatcatctatattacggtggatacccttaagtacctgaagaagggaggcaggatcacgcctgcggctgctgcccttggcaccttgttgaaaattaagccggtgctgaccatagaaggggagaagctggatgcattttcaaaggcaaggaccatgaagcaggcgaggcagaccatgctgacggccctggcccatgacctggaggagcgtttgggcgacaaggatgcagggcatacctatcttcagattgcccatacctgcaatgaggaagcggcggaggaactggcggaaacggtaaaggaactgtatcccctggcgccggtgtttgcggcccctctttcactgagcattggctgtcatatcgggccgggagcccttgcggttgcctgtaccaaaaagttaaaggagctggagtaattgcccaaggaaaaattcatggatagacttcgcacctatggcatgagcataaaggtgccgctggccggacttgtgattgcagtggccatcctgcccctgttccttcaggccgctgtcatgctggggtcttttaaccagggacagctggacgccaggaccatagagatacagaaccagtgcgtcatcctgagtaataagatgaccaggtccggctacatgactgcggagaagaagaacgccacgggattggacagccagatgcaggccattgcagatgtatataatggaaggattgtcattgtgaacaccaacttccgtgtggtcacggatacctttaacctggcaaccggcaagtattatatatcagaggaagtcatcaagtgctttaaaggggagaacagcagccattataacagggacatgcagtatctggcccagaccatacccatatctgacccggccaatgaaaagagcattaacggagtgattgtggtcaccgcctccacggagaatatcctgtccctgacagataaggccatgggcaaatccaacctgttcctggtatgcatgtgcctggtgctggccgtgctggcagcggctgcggtccatatcatcatgcggccctttaagaaactgcagatgtcctttgaccgggtggcccagggagacctggacgcggatatctctgaggatacctacagggagacaaggcagttatccctttccgtgcagaaatccctgagcaagctgaaggcagtggaccagtccagacaggagtttgtatccaatgtgtcccatgagctgaagacgcccattacctccatccgcgtgcttgcggattccctgatggggatggaggaggctccggtggaattataccgcgaattcatgactgacatatccgacgagatagaccgggagaaccagatcattgaggatctcctgatgctggtgaagatggataagtcggcagaaagccagatgaatatcgggcaggtgaacatcaacgcggaactggagcttatattaaaacgcctgcgtcccattgcaaagcgggggaacgtggaacttgtgctggaaagcatacgcgaggtgacggcggatgtggataaggtgaagatatcccttgccatcacgaaccttgtggaaaatgccatcaaatataaccgggattccggtatggtaagggtcacgctggacgcggaccacaagtatttttatgtgaaggtggcggatacgggaatcggtataccggaggacgccctggagcatatattcgaacgctttttccgtgtggataaagcgcgttccagggaggtgggaggcaccggactgggccttgccattgccaagaatgtaatccagatgcatcatggcattatcgatgtggaaagcacgcctggagagggcactaccttcagcatgagggttcccctgacctatgtgccgagacaggaggtgaagtcatgatcaggacgggattaaggaaaatgcttctgttttgggtatttttaatcatgtcttcatgggcgttcatgggctgcagcagggatgagacacctacggctgcgccggaggaaggcacctacctggtttattacctgaattcagcgattacaaagctggtacccaggtcatatgaggctgtttcaaccaatcaggaggcccttgtggcggaactgatggaccagttcatccatgttcccaaggatctggactgtcagccaggtatcacggataaggtgacatttcagggaagccgtcaggaagagcaggtcctgtacctgtattttgatgtgaactacacggccatgaagcctgagcgggaaatactctgccgggcagccctgaccaggatgatgacccagatccagggggttgactatatcagcatatactgcggggaccagccgctgatggaccgccagggcaatccggtgggggtactgacatctggtgatttcatcatgaataccagcaatgtaaatgcatacgagaagacggagctgaccctttattttgcggatgaagccggcgccagcctggtggaggaaaaacgtgaggtggtccataatatcaacacctccctggaacagctcattgtggaacagctcattgcagggcccggacaggagggccattaccccacccttccggcggactgcaagatactgagcctgtccgtgacggacaatgtgtgctatatcaactttgactcggcattccttgcaaccacgcttccggtcagtgaatatgtgcctatctattccattgtggattccctttcagagatgacatcggtgaccaaggtacagattctggtgaacggttcgcagaatgtgatgttcagggatgtgatttccctcaataccgcctttgagagaagccaggagtatatcgaaggcgcgcagtagggaatgctgcggatccattcccgccgcgtggtgcgtttgaaactgaattgaaaggaaaaacttaatatgaaaagaccgcttattgtattggcagctggttttgtacttggagaggtgcttgccctgcaaggtcaaaaagcggtgtcccaggggcttttgtggtggctgtatgccgccgcagggctttttggggtgtggtcataccggatgttgttcccaccatccggcggaaaaagacagggcagcagtgctggaaaaacagcgcttctgctcttttttgtgctggcagccggagggtgtgccgggtatgccagaggtgcatgggaaagggacaggctggaccgtgaagaagtatcagccggggaatttgcaggcgccagggccgttgttcagggaacgatagggaaggcagaacctggggaaggcagtttatcccttgtactggaggcggtcaaggcccgggtggggaaggttggcagggaatatgaccgggtgattgtttatgtgaaagatgaaggggatggcgggctgccgcgtctgtttcccgggatggcggttgagataagaggcaagctggaggcaatagagaggcccaggaacccaggggaatttgattttcgcaggtattaccgttccaaaggcgctgcatgcaggatgtttggggagcaattaaaggtcacaggagaagagtacattccttaccagacctttcttatgaagttcagatcaggatgcgccgggatacttgacagaatctgcccggcacaggacagcgcggtgttcaaggcagtacttctcggggacacatccggcatggaaccggaggtgcgctccatgtaccagcgtcatgggatttcccatcttttggcggtcagcggccagcacctggccattatagggggaggaatctatcttatcatgcgccgtctggggctgggctttggccgtgccgggatgatgggggcgatgttcgtcataagctatggaatcatgacaggaagttccggctctgccatccgggctgtaatcatgaccatgtgtctgtggctggcagcgtatgggggaagaagttacgatactttgtccgccctggggcttgcagcaatcatccttttgtggaaatccccgtatctgctgtttgccagcggtttccagctgtcttttggcgcggtatctgccatcgggggtctgggcggctggctcaggtctggttttcatatggaaaaaggatggaggaacacaatcctgatgagcctgtgcgtccagattgtcataacgcctgtggtgctttaccattattaccagcatcccttgtacggcattttcatgaatcttctggtgataccgcttatagccatactcatgtattcggggattctgggaatctttctgggaagtttctggctgaagggaggaatcatcgcagtcggggcagggcactatgtgctgtgtttttatgagtggctgtgcaggcaggcggaacgcctgccgggatactgtcttgtgatggggaggccgtcctggattcagatagtcctgtatggagccgggatggccggggcgctgtatgggatccggcggttggggggcgaggaacatggggatgggatggatgatggtataatggatggcaaaaatgaggggagaagggatggaatagtaggtaacgtaagggatggcacagacgatagaataaaagatggcgtaaacaatagcaatagggacaaggttggtggtggaaagtgcaggtaccatatatccaggttccctatagcggtaactgcatgtctgtatggccttttctttttaatcctgcttcctgtaccgggaaaggggttagaggtaataatgctggatgtggggcagggagacggaatcgtgatgcgtacggaagcatttaccatactggtagacggcggaagcagcagtgacaaaagcctgggggagaaaacactggaaccatgtcttaaaagtatgggtgtggatacggttgattttgctgtggtgagccatggggatagtgaccatataagcggtctgctgtatcttatggaacactcagaggacatcagggtcaggaacctgatacttcccatgcctggccggggtcaggagatatatgatgaattggagcaggcagcggaggctgcgggcggaaaagttttctacttggcaccatcggattgcatacaggcaggcggcctttatctgacctgtctgtatgcagggggagaaccgccgccgtcagatgaccgcaacgcccattcactggtactgtgtgcggattataaaggcttccatatgctttttaccggggatatggggacggagcaggaaaagggaatgctgaaactggcagaaaaggagggaagccttcagcaggaacatctaagccatgtacaggtgctgaaaatggcccatcatggttccaatacgtcctctggcgaggaattcctggactatttgaatccggacctggcgcttgtctcatatgggaagggcaattcttatggtcatccgtcccctgaagtgatggaacggatgaaaaaatgccgtatccctgtgatggagacaggatacggcggcgcagtcatattgcggacggatgggaaaacgctcaggtgtggatactttatggatggcaggagatagacagccggctgtttatgcaaagaagtatcggcagaggtggcgtttgggatttcactccgtatcctcctgatgcgtgtctgaccgtttatttccactgattcgggctgcgcagtattttttccagaagggcattgcatccagtggtgatgtcattccaggtggtttcaaaatcacctgtataccaggggtccgccacatccctgctgctgccggcaaattccagtaacttatggattttgttatccgggtcgcctccggtgatgcgtgtcatgttgcggatgttccagtcatccattccaatcagataatcaaatgtcccatagtccctgggtttcatctgtttggcctgatggccctgacagctgatgcctgcctggcgcagtttttcccgggtgccctggtgggcgctgtttccaatctcctctgtggaggtggcggctgaatcgaggaaaaacatgtcctccagtccttttttgtggaccaggtcctggaaatagtagagggccatggggcttctgcatatgttgccatggcagataaatagtatttttatcatcttgattatatcccttcataagccttcaaaccttgatattacgggctgtccggcgcttttttcatttttcgtgttttgctccaaacctactctaatctttgtaaatctacgcaaattcacaggggaatggtgtagtaaaagtgatattcaaatcacttctcaatgctgatcgtggttcagtcttacccttgtatacaattcataatcacgcttaccatcatttctttctcctctgggttggattctgcaatcataattgtaagagccacaagagtgtggtcatctatcaatttttctccatttttgaatagcacattatttttgtccaaaaagtaaagaaatattgtggctgctattcttttattaccgtcggaaaagctgtgatttttcgttacaaagtatagaagatttgcagctttttcttcaagcgttggatacacatcttcaccggaaaagctttgataaattgctccaatgctccccttaaaagaatcatctttttcatttccaaaaagagaactgctgtcgccaaatttcatactgctaattacatctctgcattcttcataagtcaagacatagattgccttgtttcctgttgggcggctcatattctgatgatcatacgcatctaaaagttccagtgcctgactatatttttcaacaactgtcaacacttgttttgtatcaagactattttctgctcttttcataacacgtattacctcatttaactgattcatacgattatgattcacagcataacctttgattatgtactcttttaaaatagaatttgcccaacgccggaattcaacaccgcgtttagactttacacgataaccaacagagataatgacatctaaagtataaaacggaactggttgttttactccatcaacacgcaatttttgcgtgttgttctctttgtccaactcttcatctgtgaagacattatttatatgttttcttattgttttttcatcacgttcaaataaaagtgacatttgattagcgctaagccatactgtatcgttttctattgatactggtaaaaaaattcttttatctttcgtttcaaatagcacaatctcttttttatcatccattacatttctcctgttactttattttattataacagaacactttccatataacatacttcctgccacaattgggtagaaaccgtctacccaattcatatcacaacaaaatatctgtcaaaattccacactaatacaaaaagtactctttttaaatttttacttgtcacatcaaggctctgacctaaattcaaatggcgtagtagtggtgtggtaagcgcctttctctgtcgtgaagccattgattttactggcttttccgggatttttcaagatgttgccgtggcagacgaaaaggatattaatggtattctgaaattgcttgctcatacacgttatctccgttgaattttgatagctaaagtctactataaatttgcgtgatggacaagagcaattttctgtttgcgacctttacagccagtttatcatttcgtataatgggtacaggcagttctgatctgaccccaaaaagttagacaaaaattgatggttacgcaactaatgaggattgaatcctgtattggacagggctcagtccttttagtttgttcttaatccgtttgttattatagtaatctatatatttttccagttcaactcgaaattcttctacggagctaaattccctcaaatacagcaattccgatttcagcaatccaaaaaaattctccatgacagaattgtctaggcagtttcctttcctggacatgctttgacggatacctttttcctgtaaccgcttttggtattgtttgtgctgatattgccatccctgatcactatgaaagataaggtttgtatcctccggaatctttaaaaatgcctgatcgagcatatctaggacctgattcagtactggatgttcactgatgttataactgatgatctccccattatacatatcgaggattggcgaaagatacagtttctttccaaacaaagagaactcggttatatctgttgtccattttttatttggcgcatctgccttaaaattccgttgaatgagatttggtgctattttacctacctgccctttgtaagaccggtattttttgattcttaccatgcatttcaagcctagagcgtgtttgaaaattgctttccgtcagctgtgcgtcccactttgtgggagatttggtcccgatgagggaggcgtagcgggctacgttgaccgaattgggaccaaatatgccgcgaagtggggcgtgcagatggcgggaatgaattttcaaacaggctctagcagtcccatcagacgctgtaccgttttgtgattaatcctgtaaccacggttgtggagctccatagtaatccggcgataaccatagcgtccttgatttttcccgctcttgaactaaggcgttcaatttttttaagtattcattctccattcgaaggcgttgcacttctgccaataaatcttcgttcgtatttatatcgtttttagtttttccaggtcgttttgttcccatcttagaagcccttcctcgattttctttatatagagcctcttttccttcttcatcgtatttccgttcccacataagtaccgttcttggggatggaatattaaaatgagcggcagtctgctgttgggaggctcctgtgctatgcatatattctacaacagaaaccttaaaatctccactgtatgttccaggccttgtgcaaagcccggcctccccattttcattatatagatgaatccactttctcaaggaggatctgtccatgcaatatttttgggccaacgctttaatacccagaccaccctcaaagtattcctttaccaacttaagctttaattcatcactgtacattcttcttcctgacatagaaaaaccccttttattagacgatttttctgtctaacaaaagggggttcacttcacctaccaaagcaaatgtgactattttttgagttaaaattctttggaagccactcactggagtgaactgccttttttgtacctttattataaaacaagtttggtttatctgtcaatcatgatttttacgtgtgatagcgtcagtttactttcggaaacaagaggataggactcatccctatggcatgattaaaatctgttccttccaggttgtcatatcctgtctgttttttaccgcctcttttcagtttcctgattttacgttcagcagacacacaaaccaaaggttccctgccgcttgccttccttgacttgtgcgtatgcttccctgtatggttgtagtcagataataaaacgtattttaggcaaccagctcccggttaatccgtacgcgcatccatttcaggctatgctgttcaaaccctggcacccagtcgcacccatgccctctccagtccatcgggcggcggctcagcctcttgctcggtacatggcttacctggccttgtatacagcatttccagttggtccctgcctcttccgcccggattcagattccgtcccattggttcaggaaatcgccaagtgccccctctacctccgcatacttcctgtcttcctctgttaccttcagaatctcaccatagaccttctgcaacatttttgtggtgaccctcaggcattcccagattccaccttttacttcttccgcgctgtccggtggatgcgataccgaggcattcacatatttcatcgtatggaacttatccagcacaaaacggcccttccataggacttcacaggaagactggagccgccggtagatgtcaaggactgctttttcatccagtggcgcacgggtgaaggactgatgtatgggccggatggatttctcaacaagaaagtacagagtgaccggctcaatggatttgtggtccaaaggatcggcaggcctctgataaaggttatgaaatgccttttttattatacagaaaaatgggggtacaatttaagtcaattattcgaggtttgctgtagtaataggagtgttcttaaatgaatccaggagaattttcaaataaatttgaagtgacattagccgaatcaggagcgttgccgaagggatttggagtcttgccagataatttagaagacttaccggacaaagtacaggggcataccatgtgctttgcagaccggacttatgaccggagagaaatgatttccttaaatggcctggcttatggtataataaacccataatatgacagttcaaatatactatgtgaatcccttaatgttttatcagacttataataaaacattgagttaccggattgtgattgcaggaggatgaaggattatgggaaaaggatggaaaagagaaaggaaaaggggctgggtgcatacgtctgttaccatctgcacatccgctttcttttgtttgactgcagtcttctgcggggcagtgtttctgggcggctgtgcaggaacaggcagcgccagtgtaaaagctccagcacctaaaacagtaaattacaaggctgatgactacgacagctggaatgaattgatgcaagaaaaccagatatcagattcctttaaagatgcactggagcaatttgcctttcagagcggaagccgggtcctgagggcaggccatgggaatgtcaattacagtcccctcagtctgtactatgcgctggccatggctggatgcggtgcagacggtgagactgctgcccagataatggacagccttggggtgcaggaccaaagccagctatccgggcaatgcaggaagctttatcaatggttttattatgatgggcagcatcgaaagagccggaaccaggaatataaggaagaagatgacagttccatagagttggccaattccctctggatttccaatcagctgaaactgaaaaaggattaccggaaaatggctgccgcccagttctttgcatcttcctatcaggtggatttcaccagccgggaagccggggtacagatgggaaaatggatttcccaggagacagatggagtgatgcagcctgaattacaattgtcttccgatacaatgatggcgattttgaatacattgtatttttatggaggctggaagggtgccttttctgtggcagaaacagctgatgataactttacaaagactgatggcagccaagtgacctgttccttcatgaaccgtgtggataattccgggagattcaggaaaggggatggctgcacggtgtctgccctggccacaggcaataactgcagcatggtattcctgctgccggaccaggggcatagtgtggatgagttccttaatacgccggagcagctggaaacctctatggatacggattacagaaaatggaagagcggtaaggtgacatggaaagtacctaaattctcctttggcagtacatttgaactgaccgggctgttgcaggacatgggcgtggagaaaatgtttgttccaaaagctgagttcagcaaaatctcagaatcgcccttgtttgtaaccaatgttattcaggaaacgcatatggggattgacgagaaaggggtggaaggagccgcttataccatgatagtcttagaagaagcaggtatcttcatgtctgaagagaaactggaggcagatatgattctggaccgtccgttcatctatgggatacaggacaatagaaccggtacatggctgttcctgggcgtgtgccgtaatccggcggatgggcagtaggataaaatggtatatgggctgatgcactttaaaccatgatatatcgcgaactatagatacacagaaaatcgtgatacgcagcaaaccatggtatacagcagaccgtgatatacagcaaatcgtgatacacagtaaaccgtgatacacagcaaaccatggtatacagcagaccgtgatatatagcaaatcgtgatacacagtaaaccgtgatacacggcaaaccgtgatacacagcaaaccatgatatacagcaagtatatgggatatgttgcaaatcatgggattaaacggaggaactataatgagatgtagtagagtcgtaacagcgatactgctctgtgcggtattttccggcagtattccttctatgcatggagaaatcctggcgtcccaaacaggaaagccccatgccgcggcgtcccggataggaaagctccgggcggcggtatcccaggcaggaaaaatccaggccgcggcgtcccagacaggcaccgcccagttcactgaatcccggacctatcccgatacggtacgctggttcacagccacctatgctgtctggagtgtgcgcaatggcgctgacctttatacgccgggaggaggaacgccggatgaagcattttatgcattggtcattaaaagcgtcatggagcgggactggggtatccgggaccgccagtctgcccagtcaatgatttcatggctggagaacgaggggcataaccaggcgctattgaagtattatgaggagcatgatctggggcagtatgagacggatatagatttgaatgcatcctgggacagcggccagggggaaatctccgatggggaagcggcccggcagatggctgcatatatgggatacaggacatatggggcgtatgctgcctcgggatgggactacagccgcgccctgatgctgttaggccagtgttatgtggcggggtactatacgtatgaggaggccatggacaagtccctggagttggggaaaaagctccagtccatgttcccgtcctgggaggatttcatgcagagctatatgtatggattcgtgtactggagcagatcagaccctacagaaccacagtccgagtttcagtaccgtgtaagcatttatcactatctggactctttggaggacggtccatttaagatggattggaacatggaactgaaaaaagagtggtgatcatggcctgatttgtgctatacttaatacagaatatggaaggacagcccttatatgcagacattaaaccaggacataaaggaccacagctttaaaccggtgtacctcctgtttggcgaagaggcatttctgaaaaagagctataagaaccgcctaaaggatgccatcacggacggcgacaccatgaattataattattatgagggaaagggcatgaatgtgaacgaaatcatcggcctttccgataccatgccatttttttctgaaaagcggcttatactgatggaggacagcgggttcttcaagggcggtgccggtgcggatgagatggcgcagtacatggagcacattcctgaaaccacatgtcttatttttgtggaatcagaagtggataaaaggagcagactatataaggcagttaaaaagtacgggtacgcggcggaactgtcacatcaggattccagccggctggccagatgggctgcaggcatcctgtctaaaaatggcaggaagataacaggacgtaccatggagtttttcctcagcaagaccggggatgacatggagaatataagttcggagctggaaaagcttatcagttataccatgggccgtgatattgttacggatgaggacgtggagacaatctgcaccacccaggtgaccaacaagatatttgatatgattagcgctatttcagccaggcagacaaggaaggccatggacctgtacgaagacctgctgacgctgaaggagccgcccatgcggattcttttcctgattgccaggcagtttaaccagatattacaggtgaaggaactggtgggaaaaggaatggataaggggaccattgcatctaaacttaaactgcagccctttgtggtggggaaaatcatgctccaggcaaagacattttcaaaagagcagatcctatcctatgtgaacctctgtgtggatgcagaggaaggtgtgaagacaggtaagctccaggacaggcttgccgtggaacttttgataaccaatcaatattaataagaaggatgaaggcgatggatatgatggagacaattgaactgaaggatattgaatgccaggtaaaacaggtgtttaaggaactgcttgaggtggcccgtttaaagcctggtcagatactggtcgtgggctgctcttccagcgagatagacagctttaagattggttcccactccaacggtgatatcgggatggctgtatatacagccctgaatgaggagtgcaggcccctggggatttatctggcggcacagtgctgcgagcatcttaaccgagcactgatcctggaagaggaggctgcgctgaaatatggctatgagccggtcaatgtggttccccagctcaaagcaggaggttcctttgcgacggcagcatatgcaaccctggaacggcctgtggcggtggaacacataaaggcgcatgcggggattgacatcggggatacccttatcggcatgcatttaaaggatgtagccgtgcctgtgcgcatccagaccaaggaaatcggcagcgcccacgtggtatgcgcaagaaccaggcctaagttcattggcggtataagagcccgctatgatgaggagaatatgtagcaaaaacaataacaaggaggagtggtttatgaacagagcgattacaatcagccgtcagtatggaagcgggggcagggagctgggggaaaagctggctaagaagcttgggattcccttctatgacaaggaattgattgcaatgatagccaaagagggcaacatagaaccatccatactggaagcaaatgatgaggtggaaccggacctggacaactactccacccgtctgattgaaccggaataccagattgccatgacacagcgcatttacgcggtccaggagacagtcatcaaatcattggcggaaaagggcgcgtgtgtgattgtgggccgctgcgcggatgccatacttcctgatgcagtgaatatcttcgtatttgctgatatggagagccgcatcaggcggatcatgtcccttaatcctgacctgtccagggacgaggcagtgaacagcattgaaatcgtggacaggaggcgcaaggcctatcatgagtattattccccaatcgagtggggaaagatggatgcctatgacatctgcgtgaacagcggtttgattggcgtggacggctgcctggacgcggccctggcgtatatagggcatgtaagatagtacataatgaagcaggacatgataaagaagtacataataaagaagtatttaataagtatataagtatataagtatataagtatataagtatatccgaaagccctgatggccggtcatctgatgatgtctgtgccctcagggcttcttggcttatgatggaatgaaaatggatgagattcatatataaggccagataaagccagggatgacaccgtatcggaaatcgtccctggcttttgtgccctttaatgattgattaattccctccaggcccatcccgccgtggccttgaagattccggcagcggttccacataaccgcagctttgcttctttacatggtccgtgtcgttggagcagtccctgttggttgcctgggctgtttctttttcctggttcattgttatcacctcctggttcggatattccgtctgtttgcgaaaaaggcagctgtcagctgccttctttcacaatcttttccagaacctgaatcaaatcctgcaaggtttccaggtgcacattgcgcttcaatatgtcattcttcaggtctatggaaagactttcaaatttgtcccgtattttcggggaaacataggatgccatttctatcacctcggtgttagtatgcggcaaagcggggactttattcatggttcatgaatcatcattcattattctttgttcatctggctccggtactgtttcggggacactccatgtatccgtttgaaaattttaatgaaataatttacatccgtaaacccgcagccggcagccaccacatgaacgggcagggttgttgagttgagcaggagcagggaatgacgtatacggacactgtggatgtaatcagtcaggttgcccccggtctcctttttgaacagcgccgacagatatgacttggtcacatggcacatgtccgcaaaaaaggcaagggtcagcggctcggcatagtggaaatccgtatatgtgatacagcgctgtatgatttgggaataattcttcatggagtggttccttacgagaaggcagtacttgtggaccatttcattgtcaatggcatccagctcgctcatggaacgggcctggttgatgcggacggcaaagcgggtggagaggtcatcaatataaacgggatgtacgtgccctttctgcacggatttgcggcaaagtgtgttgaagatgatcatcaggttttttctgttcaccagggcattatccgtgcgcggtgtaatccggtaggttttaaacagggtgtaataccggctggccttgtcctggtttccgcaggtaatggcatccagcatcttttcctctacctcatatcgctcctcaatgctactcatggcaatggtggggctttcgtttaaatgcaggctgtccggagcagattccaacgaaagcccgccctcccctggaatgggacggaacgtatggtccacgccgaacaggttgtccgcgatggttacaatggttgcttcaaatgcctttaaatccgcaggaaccggcacattattgtaaaatgcctgaagttcccgaagcaggttgtcaggcagctttttgcgggccatggtccgttgtatctgggtgatggtgggaggtgtttccagcacaggaccggccagtatgaccacatcccgggacacaggggacaaagatgcgcgtccaatccgtatgatatagaggatgagggaaaaatcatcggtgagctttatgatttcccctacatggcagccctgttgaatcagatattccagtccgctgtaatcataatcagaataaagcttatatcttaactccatatctgccttatacaggttggagaaatcaggttccacctgaaggcagttcacatggtgggcctggacaatctgggagaacaggttgaggatatccgtattcatcgaattttcctttcttaacaaaaaattaatacgattatttttcgattatttagaatgatattatactattttccagtataacaaaaaatcatactattttaaagtaatattctctcttttttattcttggattttaaggtacattccaatcagcacaattactttatgcgaaggaggaagtcaatatgggacatttggacagcaacccttttgcaggatttaaaaagcagaaggactatctgatatgcgttgattcagacggatgcgccatggataccatggacatcaaacattttaaatgcttcggtccctgcatggtaagggaatggggattggaaagctggaaaaaagatatcctggaccaatggaataaagtcaacctgtattccatgacaaggggaatcaaccggtttaaagccctggcccttgtactggaatgggttgacagcctatactgccagattccgggaatccaggaactggcagcatggaccagggaggcagacgaactttcaaacagctcccttgagagacaaatgcgttcctgccccagtatctgccttaagaaggcacttgactggtcagggacagtgaaccgggaaatcagccggcttcccaaggcggatatgaagccgtttccaggcgtaaaggaaggaatcatgttggcgcatcagtatgcggatattgcagttgtgtcatccgctaatccggacgcggtggcagatgagtggggcaggcatgggcttttggcagatgtagatatcctgctggcgcaggacgcaggctccaagtcttactgcattggaaagcttctggaatatggatatgaaaatgaccatgtgatgatggttggagatgcgccgggagactgtcaggcagccgggatgaacagtgtgcacttttatcccatcctggtaaaccgtgaatacgagagctggatgaccatcatgaaatcagtgaaacgtctggttgatggcacgtttacccaggagtgggagaaacagcttagggatggatttgaaatgaatctgaaggcgtagatgacagcggacgcacggacacaggagtttcacatttacaaagagaaggagaataggataatggtagatttaagaaagaaaccgtactatcttaacgaggaacaggtaaaatgggtggaggaaaccataagttccatgagcctggaagaaaaaatcgggcagcttttcgtaaacatggtagctaatgcgaaggagcgtaagcctgaaaatattaaggcggtaattgatacatatcacccaggcgccatccgataccacaatgcgcctaaggaggaattgtgggaaatgtcaaagaacctgcaggatgtatccaggattccccttctcattgcatccaattgtgagatgggcggaaacggcggggtcaatgagggcacgcctcttgccaacggggcggccatggcggccatggacagcgaggaagctgtatacgagatggcttccatcagtgcaatggaaagcgcggccgtgggatgcaactggaactttgcaccgattgtggacctgacttacaactggaggaatactattgtccagctcagggcgttcaatgataagccggaggatgtcatccggtatgcaaaatccttttttaagggcatgaagacacagaattttgccacctgcatgaagcatttcccaggagacggcacggaagaaaatgaccagcacctgattatgggcatcaatgatatgagtgtggatgagtgggataaaagctttggacgggtgtataaggaactgattgacgagggctgcatgactatcatggcaggccatattgcccttcctgcctattccaggaaactctgccctggtattaaggacgaggacatacgacccgctaccctggcccctgaactgataaacggactgttaaaggagcagcttggattcaatggtcttgtggtcacggatgcatcccatatgattggtatgtttggcgcaaccattccaagaagggaacaggttccgggtgcaattgcagccgggtgcgacatgtatctgttctttaatgaccgggacgaggatttcggatatatgatggaaggctatcaaaacggcaccatcacggaggagcggttaaacgatgcccttcacaggatacttggaattaaggcagccctcaatctccatgtgcttaaagcagaggggatgctggttccgccaaaggataacctggctgtcgtgggatgcagggagcaccacgatgcagcggccaggatggcggaccgttttgtgacactggtcaaagaccggtgtaattaccttcccatgacaacggaccggtataaaaaactgaagctggtctacatcggctccgaggccacggtgattgcaggcacaaaattcaagagcaatgatgatgaaatcataaaagatattgtcacccagctggaagcacaggggtttgaagtggatgcaatggtagaccagaaaaagggaaagatggaagcatttaaaagcagatttgacgcagtgcttctggtactgaatgtgcagggttttgcccagttcaacaccatgcgcgtgaaatgggatgaaccggccaaacagccatggtacatgtcggaacttccaacctttgttgtgtccttaagttatacgaataacctgattgacgtacccatggcgcgctgctacattaatgcatatatgccccaccatgaggcatttgaggcagcccttgataagatgatgggaaagagtgaattcaaaggacgctgtaatgacaatgttttctgcggaagatgggaaacaagattctaagggggataagaaaatggaagacagacagaacaggccctttgggctgagagataaaataggttatttattcggggatttcggcaatgactttacatttatgtttgccagcacattcctcatggtgttctatatgaaggtactgggtatccctggtgccctggtgggaaccctgttcctggcagccagggtggtggatgcattcacggacattacaatgggacgtattgtggacgtgtgcagaccgggaaaggacggtcggttcaaaccatggatacgccgtatggcggggccggtggcaattgccagtttcctgatgtatcaatcttcactggccggtgcatccatgaccgtcaaggtcgtatatatgtatgtgacctatctattgtggggaagtatctgttatacaggtatcaatataccttacggctccatggcttccgctatcacggataagccggatgagcgtacggccctgtccacgttccgtggcatcggagctaatctggcccagctggtcatcggggttcttgggcctgtcattatctataccacggatgagggcggcgcccaggtaatccggaatgacggagccatattcccggtcatggcaggtgtcttctccatatgcgccattatctgttatatcatctgctataagtgcaccacggaaagggtgaagattgaaaaggacccggatgctcctaaggtgacgctggcaaagacctttgctaccatattttccagcagggccatgctgggaatcatcggggcagcattgttcctgatgctgagccagctgctgatcggcggccttaataattacctgtatgcggattactttggggatattaaggcattttccagctatacattcatcaatatcatgctgtctcttgtgctggcagcctttgtcggcggcattaccaggcgcatgggcaagaaggaagccgctgtggtggccacggcgtttactggtgtggtttacctgatattatttgcgctgaaactcagtaacccgtggatttatatggtgtcagccgcaattggtttccttggcgtgaacttctttaacctggttatctgggctaacatcacggatgttattgacgatgcagaagtaaagaatggaaaaagggaggacgggaccatctacgctgtctattcctttgcaagaaaggtgggccaggcactggccggcgggctgagcggctatgcgctgcagatgattggctatgagtcggcggccaaaatacagacaccggaagtcttaaatggcctctataccatctccaccctggttcccgcgcttttgttcttctgtgtgaccctgatgctgctctttgtatatcctttaggaaagaagaaagtagaagagaactccgcaatcctgagggaacgcagggctgcccgataaaaacagcaacaaaaaaccatcatcggtgggttaagccggtgatggtttattcattaccaattcattcgtcatctctataaattaagcgatggaattaacagccttggataaacgggataccttgcgggaagccgtattgctgtgatatactcccttggtacaagccttatcaatctcagaagtagcagccagtaatgcagcctgggcagcagccttgtccccagcagcaatagcagcgtccaccttcttgatagcggttttaaccttggatctgatcgccttatttcttgcagccttagtctcgtttactaagattcttttctttgcagatttaatgttagccaatgaaatacacctccgtttctttacgtataatctttgtgttttccatcaaagtctggacacggacagtttaatgtaaacatactattgtattctagctgatctggaacggaatgtcaagacaaaaatggagtaattttcaagaaaaacaatagaaatcagaagaatcctgtctgtggcagccagaatcccttgttataagccctggcggttgaaaataacccgttccggcatgatttccaaaagggagcttaagagtttttcaaaattctcatccgtggattcacggcgtccaatccgctcaccgcccttgtaaaaattcatgatggtccttctgccccaaaagcagacctcaacttttgtaaggtttggatacctgcacctgatggtccttccccagaacttatggattataatacctccgtggcctgcaattaatttgcgtccaaacggtgatgcggccggggaaagggcaaggaggcccaggaatgtttgaatctgtcttcccatcaatgtcaaaccacatccaccctgcgctttgcctcgtatcatggaataaaaatctgctattttgcctaaaataaccatagtaaacgtacaaatatcaggcgagaggtgaatgggtatgcaggaaaatgatgccgtagaggcagtaaatacagggttacagggagggtttgacataaggaccgaccttgcgctggagcagagggaaagctttgagggggacggcggcgagatatccggggttaagcttaaggagtggcatcaccagaaaagccaggttaagctgaccgaggtgaaaatactcaatgaccagggagccagggctatgggcaagcccaagggcacctatctgacactggaggccgaccgcctgtccaaggcggatgatgaatatcacagtgagatatcagaagagctggcgcaccagataaggaagctgatgagtgagatgattaattggaaggaagaggacctgccgtcggtactggtggtgggtcttggcaatcgttcagtcaccccggattccctggggccaagggtactgggaaacctgcaggttaccaggcatctggacggacagtatggggaaaccttcttaaaagacaggaaacttcccgccatcagcgggatagcgccaggggtcatggcacagacagggatggagacagcggaaatcctgaagggaatcatcaatgaaacccatccggatctaatcattgccattgacgccctggcagccagaagcgtgcgcaggcttggaaccaccatacagcttacggataccggaatccatccaggctcaggcgttgggaaccacaggcacagcctgacccgtgaaagcctgggggtccctgtgcttgcaatcggggtgcctaccgtggttggggcggcggccattgtccacgatacggtgtccgccctgatacgggtcctggcggacaacgataagacaaaaggaacaggcaactggattgaggatatggattcagaccagcagtaccagctgatacgggaactgctggagccggaattcggccccctgtacgtgaccccgcctgacatcgaccagtccgtgaaacagctgagcttcaccatatcagaaggaatccaccaggctgtttttccgtaggaaaaccagtggctgctataaagagaaggatgaatgacaaatgaatgaaagtagccaatgacaatgatgaatgacaaatgaatgacagtagccaatgacaatgatgaatgacaatgtgtaatgacaagcctgaaatgcagatgtacccgccatggaataaaaaacgcaatatccatatcacacctgcatatcatgatattagagcgtatttgaaaatccgtttctgctatccttcttaaggaatccgtcacaggacgtcctataggacgcttcttacgacgttcctcaggacaaagcctgtcccattccgtggcatatttggtcccggtccggtccgcgcagcctgctgtgtcttccaagccgggaccctaatttcccataaggtgtgacacacggctggcagaaagcattttccaaacacaacctagtatgatgacaggtgaaaaatgatatgagattaagacgtggaggctcagggcggctgatgcgccggtttctggccggcacaatcctgcttatgctgctgcttctcggcggacgtttcattggccgggccgcgggcagcatcccgagaaatgattacaggaacatgataaaagccggaggccagtggctggtggaggccatatggacccaggcccgccccggggagcagataaggaggggacaggatggcgacggtcagcatcagggaattactgaccctgacccatcctaccggaaataccagacggtcaggacattttaccaggaacaccagtatctggcctggtatggcaatgaggagaccggacagcagtcactggaggaaccaggcagcctgatggcatcaggccagggaaatatgtcaggccaaggaaatatgtcaggccaaggaaatatgtcaggccagggaaatatgtcaggccaaggaaatatatcaggccagggaaatacatcaggtcagggaaatgcatcaggccaggcaaatacacccggccagctatacaccacgggccagggcggagtgctgcccggcggcaatgtccttcaggcctcggaaacccttaccggcaccctgaaccgcccgcttaccggcaatacatatgtaatggagcagctggcggattatgacttcctcatgaaacatttttatagcgtacatacttctaccacagccggaagggacctgatggatgcaaagacccttctgggcaaagacatgtctatgaagggggacaattccaagccccagatcctgatttaccatacccattcccaggaggcgtttgcagattccggtccgggccagaccgtggttggggtaggggattacctgacaaagcttctggaggacaaaggttataatgtatatcacgacaagtctgtatatgatttgaaaaatggacagctggaccgcagcaaggcctacaattacgccctggacgggataacgaacatcctgcagcagaacccgtccatcgaggtggtgctggatatccaccgtgacggggtgggtgagaacctgcatctggtgacgcaggtggacggaaaggatactgcccagatcatgttttttaacggcctgagccagaccccggaaggtccgattgaatatctccagaacccgaaccgggaggataacctggccttcagcctgcagatgcagctggatgcagcggcctactatcccggctttaccaggaaaatctatctcaagggactgcgctataatgagcatctgcgtcccaagtccagcctgattgaggtgggggcgcagaccaacacatatcaggaggcgttaaatgcaatggaacccctgtcggagctgttggatatggtgctgtcaggaaaataaagggaccccggggactttatgggcaatgcagaggcataatcaaaacaaaaagttgcactcagaagcaaaaaatggtatattctactaagcgaaaccagtgcgcggggccttccccgcaatgctggctaatagactgtaagaaacctgaatgtgagaaaggaaccaatatggcccacgttgaccaaagtaaaatcagaaatttttgtatcatagcacatatcgaccacggcaagtccaccctggctgaccgtatcattgagaagaccggcctgctgaccagcagggagatgcaggagcaggtactggacaatatggatctggagcgggagcgtggaatcaccatcaaatcccaggctgtccgcaccgtatataaggcaaaggatgggaatgaatacattttcaaccttatcgacaccccgggacatgtagactttaactatgaggtatcccgcagccttgcggcctgtgacggcgcggtgctggtggtggacgcatcccagggcatagaggcccagacactggccaatgtgtatctggccctggaccatgacctggacgtgttccctgtcattaataagattgacctgccaagcgcggagcctgagagggtggctgcggagattgaggatgtgattggcctggatgccagcgacgcgccccatatatccgccaagacaggggtcaacattgaggatgtgctggaagccattgtccacaagataccggcccccgaaggggacccacaggcgccgcttcaggccctgattttcgactctacctatgattcctataaaggggtcatcattttctgccgtatcatggagggcacggtgaaaaagggcacccctatccggatgatggcaaccggggcagaagaagacgtggtggaagtgggatattttggcgccggacagttcataccgtgtgaagaactgagcgccggcatggtaggatacatcacggccagcattaagaatgtaagggacacccgggtcggagacacagtgacagggcgggacaacccctgcgccgcccctctgcccggctataagaaggtaacccccatggtgtactgcggcctttatcctgccgacggcgccaagtacaacgacctgagggacgcgctggaaaagctccagctcaatgatgcctccctgttttatgaaccggagacctcccttgccctgggatttggattccgctgcggtttcctgggcctgcttcatctggagataatcgaagagcgcctggagcgtgaatataacctggaccttgtcaccactgcccctggagttgtgtaccgtgtatataagaccacgggagagatgattgaactgaccaacccttccaaccttccggatccaacggagattgaatatatggaggagcctattgtcagcgctgaaatcatggtgacgactgaatttgtaggaccaatcatgacgctctgccaggagcgccgtggtaattaccttggcatggaatacattgagacaaccagggcactgttaaaatacgaactgcccctgaatgaaatcatttacgatttctttgacgccctcaagtcccgatccagaggatacgcgtcctttgattacgagttaaagggctacgagcgttccagcctggtgaagctggacatcctggtcaaccgggaggaggtggacgccctttccttcatcgtccatgcggattctgcttatgagcggggcaggaggatgtgtgaacggcttaaggaggaaatccccagacacctgttcgagattcccatccaggctgccatcggcggcaagatcattgcccgtgagacagtgaaagccgtgcgcaaggatgtgcttgccaagtgttacggcggtgatatcagccgtaagaggaagcttctggaaaagcagaaggaaggcaagaaacgtatgcgccagattggcaatgtagagataccacagaaggcattcatgagcgtattgaagctggatgaggaataatcatcccatgaataacaggcgtatcggatgccatgacgatttcatacagggtgctaacccttcatacagaacggatgagatgaccacattatgacaagcaaaaataaaaagcccatggagctgtatgtccatatacccttttgcgccaggaaatgcctttactgtgatttcctgtcctttagggcgctggcatcggtccatgaggcgtataccgcacagctgatacgggagatagaagcgcagggtgccttttgccgtgaataccaggtgacaaccatattcatagggggaggcactccttctgtcatggaaccatgtctgatagcggatatcatgcgcgcgctcaaatatcattttgacgtggcggaggatgcggagattaccatagaggtgaacccgggaaccctgctttacaacaaactccatatctaccgtgaggcaggaatcaaccgcctgagcatcggccttcagtccacggataaccgggagctgagggacctgggaaggatacacacctttgaggaattcctgaaaagcttccagtgtgccaggatggttggattctctaacatcaatgtggacttgatgagcagtattccggggcagaccctggagtcttttaagaatacgctgaaaaaggttgccatgctgaaaccggagcatatatctgcctacagccttatcatcgaggaggggactcctttctgggaccattatgggcagggagcggctggcagctggcggtcagccggccaggatggtaaggaacatcctatggccgctgacggcccgtcttttccgccgcttccggatgaagacacggaaaacaggatttatcacctgaccaggaccttcctcacggaacagggatatgggcgttacgagatatccaactatgcaaagcccggtcatgagtgccggcataacatcggctactggacagaggtaccctatctggggctgggactgggcgcatcctcctatctgggcggatgcaggttcagcaataccagtgacctggatatgtatctgggtctggattttaaccgggcgccggaggaggtccttgaacagcttcacggccccctgcaggaactgtccagggaggccaggatggaggagttcatgttcctgggcctgcgtcttacaaaaggggtatccgggattgattttgtttccatgttcggcatcaaactggagaccgtgttcggtcctgtcatagaacgtctgatatccgacgggcttctggagaaaaacggggtctggatttccctgaccgagtgggggatggatgtgagcaattatgtgctgagtgaattcctgctgtcgtgatttgtaatacaggtatttgaaacacagtcatgaatacgggggcatcaaaatatattgggaggagaggacggatcatgccggacatgaccatacgtgaacacatgagggatcggctgagggcggaagcggacccggaatacagggagttccacagcaggctcctgcccggaaccgcgggaatcctgggagtgcgcactccggtcctgcgggcattgtcaaaggaactgcttaaaggggactggaagggatacataagtcaggtccaggccgcctggaaggcggatggacagggggacgatggggtttattacgatgaactgatcctctggggactctgtatatgcaggggatttaaaaagtgggaggatgcggtgccttatatcaccggattcataccagccatcaacaactgggccgtatgcgatattttctgcggctccctgaaaatggcaggcagatacagacaggaggcatgggaattcatccagccctatctggagtcaggacaggagtacggcatacggttcggcgttgtcatgatgctgtcccacttcgtggatgaagaccatgtaaaagaagcgctggagcgcatggacgcagtcaggcatgagggatattatgtgaaaatggccgtggcctgggccttgtccatctacttcatcaagcttcctgaggcggtaatgccttatctggaacagaatcatctggatgactggacctacaacaaagcgctgcagaagattacggaatccttccgggtggaccaggagacgaaggcagtcatcaggtccatgaagcggccgatgaggcaggcttgaccatcaggtccatgaagcgcctgttgagacaggcttgaccggaaaaatagttgtgatatcagattacctgtgctacaatcgaattaattctgaaaacgttggcaatcaatacagaaaggagcgtatgtatgggtaatctgattaacaaggcagtggatgattttacggtacaggcatatgaccagggcaggttcagggaaattaccagggaagacacgctgggccattggtccgtgttctttttctatccagcggatttcacctttgtatgtcccacggagcttggggacctggctgacttctatgatgatttcaaggaggctggctgtgagatttattctgtctcagaggacacacattttgtccataaagcatgggcggatgcttcggacaccatcaagaagatccggtatcccatgttaggcgacccggcaggcgtgcttgcaagaaacttcggcgtgctggtggaggaagagggccaggccttaagggggacttttgtggtgaacccggaaggaaagattaaagtgtatgaaatccatgatatgggcattggcaggaacgcgcaggagctgctgcgcaaggtccaggcagcccagttcgtggaagagcacggtgaccaggtgtgtcctgccaggtggaaaccgggtgaagagacactgactcccagcctggatctggttggaatgctgtaaggaggtggctgttacgattgatcttgcaaggattccggaagaaagcagcctgattgacgaggggctgaagacacagctttccggcattttcggtaaaatggaaggccgggtggccataaaggcggtggtggacctttcaagggaaaaggactgtgagcaggcggcgttcttaaaggcggtttcagccttaagcgataagctggagctggaactttacgcgcccgaggaggccggacaggtgcctgaacttaatacacagtggcttcccgtcaccgggctttacagggacggccggtatggccgggcatcgtttcacggtgtgccgggcggcaaggagattaattccttcgtgctggcaatctataaccttgcaggccccggccaggagatgtcccggggactgaggaagaagattgacaagctggataaaaagaccaacatcaagatctgcgtttccctggcctgccatcactgtccggtcgtggtgtctgcctgccagcgcatcgccatcctcaatcccaatattgaggctgagatgattgacgcggcgctttatgaggacctggtggcaaagtacgatatcaagaggatacccatgatgatcttcaatgacagcgaaatccacatggggagcaaggaaattgaggaaatcgtcactttgttaaaataataactaaaaaatggaaaataaagcaaaaaattcattaattctgcacaaaaaatgcggtgattattgagaaaaaactgtaagaattttaagaaataaatataatgtgttgcaaatctatgtgcattatgctatattggatttagataaataatggtgctgagatgatgagagcatagtagaacgacagaaatgttggtttaacgctatgctcttttttgtttttgtttgagaaggagggggattccaatggaccagaaattttatgacctgattgaatcaaacccggtcatagcggctgtcaaggacatggatggactgaatgcctgctgtgccagggaagaaatcaaggtggtattcattcttttcggagacatctgcaacatcgggacaatcgtcagccagattaagcaggcagacaaagtggcaatggtacatgttgacctgataacaggactcagcggcaaggaagtagcggttgacttcataaagaacaatacattggcggacggcatcatttccaccaaacccggattgattaagcggggcagggagctgtccctttacacgacactcagggtattcgtgctggattccatggcatttgagaacattgaacatcagatggccgtggccagacctgacatcatagaaatcctgccggggcttatgcctaaggtaatccgcagggtgtgcagactggtccgtgtaccggtcattgcaggggggcttatatcagacaaggaagatgtgatggctgcattgtcagccggggccatatccgtttcaacaaccaacccaaaagtatggctcatgtgacacaaagggaatcaatacggaactgaactggattccacggggaatggaagacggttttagtataaatgatacataagcaggtccatggatgaaagcaccatggaaggaaatggagtgtatcacaacaagttaggaacttccgcgataggaaatatcgtggaaagaaaaggagggtttttatggcaaagtatgtaatggcactggattcaggaacaacaagcaacaggtgtatcctttttaacgagaaaggtgagatgtgcagcgttgcccagaaagaattcacacagtatttcccgaagccgggctgggtagagcacgatgccaatgaaatctggtccacacagctgggcgtagcagtagaggccatgtcgaagattggggcgacggcagaggacattgctgccatcggtatcaccaaccagcgtgagaccaccattgtatgggataaagagacaggcgagcctgtataccatgcaatcgtatggcagtgccgcaggacatctgagtactgtgacagtttaaaggataagggcctggttgataccttccgtgccaagacaggacttgtaattgacgcatatttctcaggaaccaaattaaaatggatcctggataacgtagaaggcgtgcgggaacgtgcggaaaagggcgagctgctgttcggtaccgtggagacatggctgatctggaagctgaccaagggcagggtccatgtgacggattattccaatgcatcacgtaccatgctgttcaacatcaataccctggagtgggatgacgagattctgacggaactgaacataccaaagtgcatgcttccggaagcaaaaccgtccagctgtgtttacggcaattccgattcctccttctttggcggggaaatccccattggcggcgcagcaggagaccagcagtccgcattgttcggccagacctgtttcaatgcaggcgaggcaaagaatacatatggaaccggctgcttcatgctgatgaatacaggcgagaaaccggtattctccagcaacggcctggttaccaccattgcatggggacttgacggcaaggtcaactatgcgctggaaggatccatcttcgttgcaggcgcggccatccagtggctccgcgatgagatgaggatcattgattcctcgccggattccgagtacatggccaagaaggtcaaggataccaatggctgctacgtggttcctgcatttacaggactgggagcaccccactgggatcagtatgcaagaggcaccattgtaggcattacccgcggcgtgaataagtaccatatcatccgcgcaaccctggattcactctgctaccaggtgaacgacgtactgcaggccatgaaggctgattccggcattgagctggcagcgcttaaggtggacggcggcgcaagcgccaacaattatctgatgcagacccaggccgacatcatcaacgctcctgtcaaccgtcccatgtgcgtggagacaacggcaatgggcgccgcatacctggcaggcctggcagtgggatattgggccaataaggaagaggtgcttaagaactgggcaattgaccggacatttacacctgaaatctctgaagacaagaggacagagatggtcacaggctggaacaaggcagtaaaatgttcctatggatgggcaaaagaagattaatcgtacggggtatggaactgttgacgacaaattagacaagggggtttctatatgttgccatatattgcggagtttttaggaacaatgatactgatacttttaggtgatggtgttgtagctaacgttacgctgaacaaatccggtatgaagggcgctggttccatccagattacctttgcatggggccttgcagtcatggttcccgcgttcatcttcggcgctgcgtccggcgcgcatttcaacccggccctgaccattgccctggcagtggacggcagcctggcatggggactggtcccaggatacatcgtggcgcagtttgcaggcgcatttgtgggcgcggtactggtttacctgctgttcaaggatcagtttgacgcaactgagtcagctgcaaccaagctgggtgttttctctaccggaccatctgttccgaatatgggacgcaacatcttaagtgaagcaatcggtacgttcgtacttgtatttgctataaagggtattggccaggtagcaggtattcctgctggcgttgacaaactgctggtattcggaatcatcgtatccatcggtatgtcccttggcggactgacaggttatgccatcaacccggcacgtgaccttggaccacgtattgcacatgcagtgcttccgattaagggcaaaggcgattccaactggggttatgctcctgttgtcatcatcgggccggttgtgggagcagtggttgcagcattactgtaccaggcaattccgtgggcataagttttatataattacatattgattgcgtgagagtggagcggagcaaatgggtatggaaacataccttgtttgctccgctttttatgaggcagtcgaaggaagggaacgaggaaaatgtatgacgtaataataatcggagccggagtcgcaggctctgcatctgcaagggagctgtccagatataaggtaaatgcctgtgtcctggaaagggaagaggatgtgtgctgcgggacttccaaggccaacagcgcaattgtccatgccggatatgacgcggcagaaggctccctgatggctaagctgaatgtggagggcaatcagatgatgcccggccttgcgagggaactggatttcccctttaaacagtgcggatcctttgtggtatgcctggacgaggaacagctgcccgaccttcaggcactttacgaaagaggcgtggcaaacggggtgaaggacatggaagtcatcacggataaggccagaatcagggaaatggagcctaacctgaccgatgaggtggcgggagtcctctatgcaccgaccgcaggaattgtatgtccatttaacttaaacattgcattggctgagaatgcatatacaaacggcattgacttcaaattcaacacggaagtccttgatattgaaaagattgaaggaggctgggccttaaagacaaaccagggcgtgtatgaaaccagatatgtggtaaatgcatccggtgtccatgctgacacattccacaacatggtcagccaaacaaagattcacatcaccccaaggcggggcgattactgtctgctggataagagcgcgggaaaccatgtcagccgtaccatctttgcactgcctggaaagtatgggaagggcgtactggtatctcctacggtccacggcaacctgatagtagggcctacagccatagatattgaagataaggaagccacggcaaccacaagggaaggcctggacgaactgattgacaaggcggggatgaatgtgaagaacctgcccatgaggcaggtgattacctcattcgcaggcttaagggcccatgaggaccatcatgaattcatcattgaggaactggaagacgcgcccggattcgtggactgcgccggtatcgagtcccctggccttaccagctgcccggccatcggcaggatggtggcagggatactgaaagacaggatggggctggagcccaatcctgattttgtgggaaccagaaaaggcatcctggacccggacacccttacaaaggaagaacgggcggagctgattaaggaaaagccggcttacggcaacatcatctgcaggtgtgagatggtgacggaaggggaaatcctggacgcaatccacaggcctcttggcgcccgttccctggacggcatcaagcgcaggaccagggcagggatgggacgctgccaggccgggttctgtacgccaaggtccatggaactgcttcaccgggaactgggacttcccatgacggagattaccaagtcaggcggggaatcgaaacttgtagtgggaaccaacaaggacagaatatagaaaggagcgcttaagatgaaagaatatgatatcgtcataatcggcggcggtcctgcgggtcttgctgcagctgtggcggccagggataacgggatagaaagcatcctgatactggaacgcgacagggaactgggaggaatcttaaaccagtgcatccacaatggtttcggtctccacacgtttaaggaggagcttacagggccggaatatgcggcccgctatgaggagcaggtatttgaacggaacattgagtacaaattaaacaccatggtcatggatatcagccatgataaagtggtgacagccatgaaccgggaggagggcctctttgaaatccaggccaaagccgtaatcctggcaatgggatgcagggagcgctccaggggcgcgctgaacattccgggttaccgtccggccggtatcttctccgccggcacggcccagcggctggtgaacatggaaggcttcatgcccgggcgggaagtggtgatcctgggatccggtgacatcgggctgatcatggcaaggcgtatgaccctggaaggcgccaaggtcaaggtggtggctgaactgatgccgtattccggcggcctgaagcgtaacatcgtgcagtgcctcaatgactacgacatccccctgaagctgagccataccgtggtggacatccggggcaaggaacggcttacgggaattacccttgcggctgtggatgaaaaggggaaacccattcccggaacagaggaggattatacatgtgataccctgcttctgtccgtgggactgattcctgaaaatgagctgtccggctccatgggcgtggagatgaaccgcgtcacatccggcccggtggtcaatgaaagcctggaaaccaacatcgaaggcgtatttgcctgcggcaatgtgctccacgtacatgacctggtggactttgtgtccgaggaagcggcggcagccggaaagaacgcggccaaatatgtgaaggacggggaacgggccggaggcggacaggaaatcgtcctgaatgcagtggacggagtccgctatacggttccgtgtaccgttaatccggagcgtatggaggatacccagattgtccggttccgtgtgggcaatgtttataagaactgttatatcggggtttactttaatgatgaacgggtgatgcacaggaaacgtccggttatggctcccggtgagatggaggagataaagctggaaaaagataaattactattgcatccggaacttaagaccattacaataaaggtagaggaggcataaaccatggaaaagagagaacttatctgtatcggttgtccaatggggtgtcctctgaccgttcaactggaggatggggaaatcctcagcattacaggccagacctgtaagcggggggaggtatatgccaggaacgaggtcaccaatcccaccaggattgtcacatccaccgtcatggtggaaggcggcaaggtgggaagggtttccgtcaagacaaaggacagtatacccaaaggaaagatcttccagtgtgtcaaggccttaaaaggcgtgaccgtaaaggcgcctgtgcacattggcgatgtgattgttgccaatgtggctgatacgggggtagacattgtagcaaccaggaatgcgtaagtggaatgtccgcgattgagcaccatcgtggcaagaaacagacagtcggcagctgcccaaagggaggctctaagcaacaggaatgaagctttcagcgtccgtaaaacagcggccggcttcctgtggttcatgaagcagggcggtaactaacagacgggccgtgtgaaagcggcctcaggtaaaggaggactttacatggagaaaaagcagctggatatcaacaacatgaacggaatgacggaagaagaggataaaacctgcggtcttaatgatatgaactgcgtggcagatgaagaggataagacctgcggcctcaatgacatgaactgtgtggcggatgaagaggacaagacctgcggccttaacgacatgaactgcctgggcgagtaagcggggaaggcaaagcagagactcccggagggagtccctgctttgtgcggtaatataaggggctgcatagggtccttatggagagggaccctgcaggctgtcatggaactgtatcataataatataagggggttcgcaatatgaagaaatttatcaacgatgtagcgctggtagaggaacagatgattaagggcatggtcaaggcttatccgcagtatctgaggaagctggactgcggcaacgtcgtggtgcgcgcgcataagaaggagggcaaggttgccctgattagcggcggcggcagcggacacgagcctgcgcacggcgggttcgtgggaaccgggatgctggatgcggcagttgcaggagccgtgtttacctccccgaccccggaccagatttatgagggcatcaaggcggttgcaacggacgcaggcgtgctgatggttgtgaagaactataccggtgacgtgatgaactttgagatggctgctgagatggccgagatggagggaatcacggttaagcatgtggtgaccaacgatgatgtggcggtcaaggacagtctttataccgtggggcgcagaggcgtggccgggaccattttcgtacataaaatcgcgggcgccctggcagaggaagggggaaccctggacgaggtgcaggccgttgcccagaaggtcattgataatgtgaggaccatgggcgctgccacccaggcgtgtacggttcccgcagcgggaaagccgggatttgaactgtcggatgatgagatggaagtgggaatcggcatccacggggagccgggaacccacagggaatccatgaagacagcggatgagataacggatatgctgctggagcagatcctgggggatattgattataatggttctgaggttgctgtcatgatcaatggcgcaggcgcaacgcctcttatggagctgttcatcatcaataaccatgtatcggatgtgctggctgaaaagggaatcaaggtttacaagacaatggtgggagagtacatgacatccattgagatgcagggcttctccatttccctgctccgcctggatgaggagctgaagcggctgctggacgccccggcagatactccggccttaagatagggaccgggtgaacggattatttccccgcctgtaacgggcggggtttttataatgattatgatatgaggaaatctcagaaaggtggtcaccatggcagacagtaagaaagtattggaaatcatcagggcaatcggccttaaaatggaggaaaagaaagagtatctgacggaattggaccagccaatcggggacagcgaccatggcattaacatggcaagagggttcggggcggtggaaggcaagcttccaggtctggaaggcaaggatatcgggaccattttaaagaccgtcggcatgactcttgtatccacggtgggcggcgcctcggggccgttgtacggctctgcgtatatgaaggcggggatggccatggcggggaaggaagagatggatatggatgatttcctgtccatgatgaagactgcggtggaggcagtggagcagaggggcaaggcaacggtggaggaagccaccatgctggacgccatggttccgtcgctgaaggccatggaggaagccgtggcagaggggaagaccacaaaagaagccctggatgcaggtgttcaggcggcatgggcaggagctgagcataccaaggacctggtggccaccaaggggcgcgccagctatgtgggcgagcgcggcctgggccatcaggatccgggggcaacttcctattcctatatgctggaggttgtggccggacttatgtgactggaaccataaggcggctggaacgtgtttggaatatcataggaaaatggagaggagcaaggataaggtatggtaggatttgtgattgtttcccatagcgggaatctggctaagagcgtggttgaactgacagccatcatggcgcctagcgcaaggatagcggcagcgggcggcatggatgacggaggatttgggaccagctttgagaagatacaggcagccattgagtccgtgtattcagatgacggcgtactggtgctgatggatatgggaagtgcggtaatgaccacggagatggtcatagagacatttgaaggtaaaaaggtggagatggtggactgtcccctggtggaaggggcggtagttgcaaccattgactctgtgggtggaatggactttgagtcaatcaagaaagccctggcaggagtggggacatccaggaagttctgagacaggcatgctatatgggggccgggcttacgcattggcacaccctattccttccccgtgatggttacaatcatcttgttgggaaggcatacaatggtatcgctgctcaggtgcttcttaccctggtgcacgcagaccttgtcagggcagctggcttcgctgcaccagatttccccgtcttttacaatgagatggttggtgcccccgcctgcgccggtgacagtgagttctgtatccttacttaaatccagggtccttaccaccttgccgtccacgctgatctgggctgtggcggcaggcgccctgtgtgagacatagttaaatccaaatacggccgcggcaatcagaaggatagctgcggccagtatcatatcgcgttttcctaaaactttcattgttcagctgcctgtttcaggcattcctccactccgttgataaatggatagacattgatgctgacggtagagaccgcatcggtggcataaccatcctggttggcaagtccgttcaccttctggtgttcaatgacgtatctgcccactgcgtctgcctgggctttccaggtggggccgttttccgtcatgacgtagtgcccgtccatgctcagcttctgcttgccgttgccttcggcgtcaaaggaatcccatacgcaggatacgatgatcccgtttgccacggtgatgctggttgaatccctgtatccgttggaatcaggctccggcgcttcataggtataggtgccgtcagccaggggaacctcaggctggttggtggtgacaggcccttttaatgcgtggtacaaagggttcgagactgctatgacggcaatggacatcactgccatgacagcaatgccgatggcgcttcttgtgctggaagtcattgtttttctgctcattgtatcactcctcggaatttagtagtaatgtgccgtctgaaaggtatcccggcacattgtttattttatcacaattagaacggttatacaatcaaattccgctgtaagtttaaaccaggatggattgggagcggattgatattacgggcattgaaaacatacattatatggaaatccatggtataatccttataggcgggactgagggaaggaaccgggccgggagggggaaaggtgtatggatgagcgggagaggattgaggatagaagggattgcggggggatgcaggaaaatgataaaggggattccggagggatgcaggaagatgataaaagggattccggggagatacaggaagatgataaaagggattccggggggatgcaggaagatgataaaagggattccggagggatgcaggagaatgataaaggggattccagagggatacaggagatggttttggatgggggccagggaaaggggtacaagaaggggccgacgattaccaagtgcctgatcctgttctgtatcctgtattttgtgtatcagggaccggcctgcggcaggcgggttacgtaccggttcgtgtttggccccggacaatccgcgcaggctgggctgggtgagcagtattataatgacggggagtttgaaaaagcggcggaatactatcagcaggtggtggatgacatctatgccaggggcggacggtttcagccggagaacggacccctgtattaccgcctgggggttatctactataatcttggggagtatggacaggcagttaagtatctggatgaatccgcggatgtggaccagcgtacctccaatacagaggatctggcgtgggattattttgccatagggagggttctcagggaagcgggaaaaagtgaggaatcagttgattattacaggaagggcctgaaggccattaagaaggtcagcggaaatgattcagaggatgcggctgagtttttgattggcctcggggactcctataaaaagaatgaggagcatgacaaggcgctggaatcctaccagcaggcgctggggatttatgaaaagcaccagtctgacccggtctggatatatataaggattgcaaggagctatgagaagctggatgattatgcatctgcggaatcatattataggaaagcttcacagactggaagcgcggataactatacgatgggcgtgatatggtttaatcttggcatgctgtatcaggataccgggaagggggaagaggcattttccctgtatcaggaagcgttgacactgattaataaggacggcggttatgaggctgcggagtcatcggtgcagcattaccttgcgtctgcttacgccgaaattaaaaatgatctggacagcgccatccgttattctttatcggcctgccggatcagggaggaactggcatcgccccatctggaggataaggaaaggcttggggagtttaaggaacagcttaagggcttttatcaggaatccacaggggacggcacggatgaagggtttgagtcctggtattggcagcagatggaagaggggggcttcctgataaatcctttggatacatccgggaatatatgatatactgggatgtgtttaaaagacgtgtcataaaaatgtgattcaaaggatgcgttccaaaatgattcggcaatgcactgcagggccggacaggcagaggtgtcatatggttgtaatcaacaataataagaagaaagcaggcagacagcgtatgtccaccaggaagatagccctgttcgggcttctgactgccctggctgttgtgttaggatatgtggagtccctgataccggtttatctgggggcgccgggggtgaagctgggactggctaatctggttaccatgattgccctttactgtatgggggtaagggctgcgattgccgttaatctggtccgtatctttttctcgggttttacattcggccctgcatcagccatcctttttagtctggcgggcgcaggcttaagcctgactgtcatgggggtgtgtaagaagttccgtctgttcggcatggtgggggtcagtatactgggcggggtggcccacaatatcgggcagtttatgatggccgcttatgtggtccatacctttggggtatttgcgtatcttcccgtgcttcttggggccggaaccgtggccggagccatgattgggctgttaggcgggatggtggtacagcggatcagccgggttttccgagaaatttgatatatttcctaagaaattgccattgtcttgacggcaggggcaggatataattaatagtaatgagaaaatggagggtgctgatatggtttataaagcaatcaaaggacttgtacagtatggtcttaacactggccttatcactgaggtggatgctatttatgccaggaaccagatcctggacgtaatggggatggatgagtaccaggagccggaaggggaaggatttgagggcggcctggaggaaatcttaaaggttcttatggaccatgcccatgaaaccggggttttgaaggatgacagcgtcgtatatagggatttatttgatacaaagctgatgaactgcctgatgccaaggccaagcgaggtggagcgggaattttgggagctttataaggtttccccggaaaaagccacggactggtattataagctgagccaggattcggattatatacgccgctaccggattgtcaaggatatgaagtggaccaccgatacccggtacggtacgctggatatcacggttaacctgtccaagccggagaaagaccctaaggccattgcggctgccaagcttgccaagcagagcgggtatcccaagtgccagctctgtatggaaaatgtgggctatgcgggccgcgccaaccatccggccaggaataaccacaggatcatcccggttacgattaatgacagccagtggggattccagtattctccgtatgtatattacaatgaacactgtatcgtgtttaacggccagcatattcccatgaagatagataaggccgccttcaggaagctgtttgacttcattaagcagttcccccactatttcctgggatccaatgcagaccttcccattgtgggcggttctattttgagccatgaccatttccaggggggacattatacctttgccatggctaaggctgccatggagaagcattttacatataaaggatttgaggacgtggaggctggaatcgtgttctggcccatgtccgtgctgagactgagggcagaggatgcaggccgcctgattgagctgggggacgtggtccttaatgcatggcgtgggtatacggatgaagctgcattcgtatttgcagagacagagggtgaacctcataataccataacgcccattgcgcgtaaggtgggggatatgtatgagctggacctggtactgcgcaacaatatcaccacagaggaattccctctgggcgtgtaccatccccatcaggaactgcaccatattaagaaggagaatatcggcctgattgaggtcatgggtctggcggtgctgccgtccaggcttaagacggaactggctgaactgggaacctatataatagaaggaagggacatccgcagcaatgaaacactggagaaacatgcggactgggtggatggtttccttcccaaatataaggaaaagggcattgccgttactgcggagaatgtggagtccatccttcaggaggaagtgggatatgtgttcgccagggttctggaggacgcaggtgtatataagtgtgatgaagcgggacgtgaggcatttggaagattcttaaggagtgttggattttcggaatgctaagataagatacaggaacagataagacacaggaatagataggatacagaaaagataaagatatgttacaggaacagaaggcggatatggatatgttggatccgccttctgtttttacatttcaccccctccaactttttgtaaaaagtttttgcaaatcttctatctgttcaatctcctgaaattgatttatgataaagcctgtaaggacaagacatacttcttaagcgcttaagaatcagaggtttcaatatccggcatggccggaaggaggttataaagggatgagtcaattaattaataagaattgtattgtatttgatatggaaggggacaagaaggacattatccgcaccctggcaggggagctgcacagggctggcaggataacggacgcagaggagtttttccaggatgtgctggcaagggaggccattgcggcaacctttgtgggctttgatatgggacttcctcatggcaagacagaccatgtgctggaggccagcgtgtgctttggcaggaccaggggaccggtggtgtggaatgaggagtcgggggatacggttgacctggtcatcctgatagcggttcctttgtgcgaggcaggggacacccacatgaagatcctggccaacctgtccaggaagctgatgcatgaggagttcagggattccctgaggaagagtgacagggaacaggtatacaacatattaagtgaagttctggaggggtaggaagatgaaagagcagttaaggatattaaagaaacatatattgacaggcacatcacatatgattccctttatcgtagcaggcggtatcctgttttctctggcagtcatgctgaacccggaaggggcggcaacgccggagacaggctggctggcaggacttgcacagatcggtttgggcggactgacgcttttcatccctgtgctgggcggatatattgcatattcaatcgccgacaagcccggccttgcgcctggtatgatcggggcttatctggcaagggaaatgggcgccggattcctgggcggcatggccgccggcctgatagcaggggttgtggtcaaggagttaaaacggattaagcttcccatcgcgcttaagacactgggttccatcttcatctatccgctggtggggacactggttaccggaggcatcattgtatggggcatcggagggccgattgcagcccttatgaacggtcttacggcctggctgtccgggctgggcgatgtgggtaaggtaccgctggcctccatcctgggagccatgactgcatttgacatgggcggccccatcaataaggtggcaacactgtttgcacagacccaggttgatacgcttccatacctgatgggcggcgttggcgtcgccatctgtacgccccctatcggcatgggaatcgcaacgcttctggctcctaaaaagtacaatgttgaggaaaaggaagctggcaaggcagccatccttatgggctgtgtgggtattaccgagggagccatcccatttgcggccaatgatcccttaagggtcatcccgtccctgattgtgggcgccgtggcaggcaatatcattccattcctgacaggggtcctgaaccatgcgccatggggcggaatcatcgtgcttccggttgtggaagggaaaatctggtatctgatttctgtcctggcaggtggatttgtgacagcggttatggtaaacttattaaagaaggattatgtggatgtaacggttgaaaaggaagataccgtggatctggatgagataacatttgatgaattttaaagaagataaatgtggtaaaagtaaataatgatgaaaataaatagtgatgaaaagaaaacaggattgacatggaggacgataaaatgaaagtagtaggaattacatcttgcccatcaggcgtggcacatacatacatggcggcagaagcgcttaaattatccggcgagaagctggggatggaagtaatcattgagacacagggcggagccggtgttgagaaccagttaaagcagaaggacatcgacgaggctgcatgtgtggtcattgtcaatgatgtggccctggagggactggaccggttcaagggaaagaaggtcctgaaaatgggggtttcagacctgattaagaagtctgacgctgtcatgaagaaaatccaggatacctttcagtagggtttgtcaggggagtgtataagataaagtaaaggatgaggggagcggggagcgctcctcttgtccgtgtatccatatggggcatggcagtcagggcgtccggtaaaggaacaggcaggcgccgtacaggagaagaagattatgtttaatgggagaatgcttaatatcatccgctatcttaaggaacagggggaatccacctataaggcggcggccagggatttgggggtatcggagcggagcgtgcggtatgatgtggaccggattaacgatatcctgtccctggaacacctgccggagattgaaaaacactccaagggcgtactggtgtatcccaggaacctggacttaaagggactggaggacggcaatgaggtggtatataccagccgggaacgcatgtccatcctgctgctgatcctgatgatacgcagcgaggaccttaagataaaccagctgagccagcagttcagggtgtccaggacaacggtgaagaatgatatggcggccctggatgaggaacttaagaaggatgggatgggtatcgggtattccggacatttttacctttccggcccaaagcttaagcggaccaccctgatgaaccaggagttcaggaaatacattgagtacctgattaatccttttacggaatacaattcctatgaattttactgtatccatatcatacataaggcgtttgagggcatttccattcccaatgtggtcatggcggtggacggattactggaggatctgggctgtaccctgaccagcagttcctacctgtggtacatgtccaatgtggtggtgcttatatggtatgtactgcatgacaaggtctatcccctggatatctcggtgatgcccggctatgacagggaggtttacggcaggtttgggaaggacctggaggtaatcataggcaggccggtatcaggggattatattgccatgatggcgaaaatgtttgatttcaccaataagattgcaggaggaaagggggaggtggacccggtccacgcccaggcagtgacattttccctgatttcctccatgtcaaaacggctgaacatgccctttgacaaggacagttccctggtggaagggctgctaaaccacatgattcccctgatacagaggattaataatcatgtaagcatcaaggataacgtggtttcccttctgggtccgaaggagcagcagctttacaatgtggtgacccaggcctgcagcgaggtggagacccttgaccagctgggcaatgcggatgagctggtgtatctgaccatctgcttcatggccagcatccggaggatgaagacagcgccctacaagaaggtgcttctggtgtgcgggcacggttacggcaccactaccatgttaaaggaggcgctgctcagcgaataccagatccacatcatggacacccttcctatctataagctgtcctcctaccctgactgggctgccattgattatgttttgtcaaccattaaggtgaataacagcctgccaaagccgtgcataacagtgagccccatcctgcagcaggaggacagggctgccatagaggggcttggaatctccaggaaggcaatcctttcaagctattattccattgaggaaaagcttgggttcctggatgaggcaacgcgggccagggtgatggatgtggtgaagaaggaactgggttaccagaccgcccaggtgttccataaccccaggaatttcagtagcttcctgaagtatgactgcattgaactggcagaagaggccgcggactggagggaggcggtgcgcttgagtgcagggcctctgcttaggcggggattcattgaggagtcctatgtatccaacatgatagggttcatagaagaacagggcttttatgctgtttccgacgggtcctttgcactgcttcacggaaaaggcgcagagggaatcaggaagaccagcttaagccttctggtaacaggaaaaccagtggaattcggggataagaaggccaatgtcatattctgcctggccagccgcgactccagggaacatataccggcagtggtgaccctgatgcgcatggtgaagacaacctccctgatccacgatttagtccggtgcaggacgaaggaggaggcgtaccagtgcgtgcttaactgcgagtttgaggtcctttgactgtggggaggatggggaggatgggtttgcgcacagggccagtctgtacagacaaaaaatcctgtgttataatgaactggactttgaagatgaaatcagggaaaaggagtacatggatatgttagatgagagatgggtatttcatgaaaatgcagaagcagtccaggctggaccgggagttgtgagaagggtcctggcttacagcaaggatctgatgtgtgtggagaatacatttgagaaaggcgcggtgggcagccttcaccatcatccccacacccagatcacatacgttgtaagcggtgaatttgagtttgatattgaaggtgagaaaaagattgtaaaggccggagacaccatgctgaagctggatggggtggaacatggatgcgtatgccttgaggcaggtatcctcctggatatctttaaccccatgcgccaggattttgtgtaaatccgtgaaaaggatggagaaaaaatcctgctatacagaaccatgctgcactggtgattcaggcgaaaataccggccagccccaggtcctccacctttttatggatataccctttatcaatggaatatagccccaggtcgttcatgcgccggaacaggcaggagccggaaaatgtatatttttccctcaggccttccggcgtttccatttgttccctaacccatgcaatggcctcgcccacggccagttcccgggggaattcaaggaggggacggccggagaggaactgcaccatgttatgcccggccaggacgccagtgacaatggcttctgtgtggcccaccagaagccccgccttttcaccggcacagaacaggttggcccgctggtccaccttcaggctgttgctccgcctacacatggcaagatagcgcatggagttgcctttcccgcctgcatacgggtcttcataacgggcgcattcaaatcccggaatctgatgaagcttttccagagggtaatagggagtcatcattttggcgtgtccggtgtccagcaggatgatgttttcggcaaattcatccagggcatattgctggcaggccttgatggaaagatggttttccctgagttcccggggaagggggatgacggccactccattttcatccagggcttttatgatttcgggggacagggattccttgaacagcttgcaggacccgctcatggccccatatgagccgtcatgggctgccgccttaagttcggtaagcccggtaaggccgcaaaggctgatgcgcccgccgaagctggggcagcgcagcacgcacatggcacatccgtttccatattgcctgcagttgttcataggcccggcggttcccgtggcgtcgatgaacccgtcggcctcataacagttgccactgtcgtcacggacggacaggattgtggtattgtccccggataagtctgcgctggccaccctggattgcctgtgtatggaaacgcccagctgaagcagccgctgttctactgccacgggcgtttttattatatcatacaggtcggcgtgctgatggcccggaaaggaaatgcatttgtggcgcaggcatgtgtcaatggcccggaacatatcgtccccgcccatggcagccatctcctccgtggccgtgaaacggccgttgttgcgtatgataccgcctaccagacctgttccaagcagggagtccgtgcgctccaacagggttacgctggcaccgtttttggctgcctgggcgctggccgcacagccggcccatccgcctcctacaattactattttcataatcacgcctcctcctgtatagtaagattatattatgtatccgcagggatatagacctgcaaaatgaacaaccgccatacctgtatacaagtatggcggtgctttttcctgccgcaggattcctatttctcagtgtgggggagacggcccctgaggaaccgtttccttaactcgttaagactgaagggaatcagggggtacacataactctttcctgcaatggtcttgttaaatacaatggcacagatggcgattaccgtgccgatgatatatccccatacattaaagacagcggtcagtatcaatataatcacacgcatgaacttcatggcatagcccagttcaaaactggcctgggaataattggcaatcgtcacgaatgccatgtacagcatggtctcactgttaaaccatccggatttcaccgcatattccccaagcacgatacctgcaatcacactcagcggggtggttagcatgctgggggtattcaccgctgccagccgcaggccgtcaatggcaaattccagtatgagcagctgccatataaggggcacgttcagtgggtcggacacgcgtatgaatgccagccagtccgggatataggcaggattctgcatgaacaggagccatgtgggggtcagcatcagggccaggacggagatggtcatcctggataaacgcaggtaggttcctgttacaggcgggaagtagtagtcatccgcctcctcgatgatgtcgaacacggaggagggaaggatcatggctgaaggggagttgtccaccagtatgatgatatttccctccaggaccgatgcggcggccgtgtccgggcgctctgaaaatttaaacttgggaaatggattgaaccatttatacgggaaaatgcactctgccagactttcctggttcatggtcagggcatccaccttcaggtccttaatccggtcctttattttcttcagaagctgtttatccacccggttttccatgtagcagatggcgatgtcggtgtgggagctttcgcctgcggacatgatttccatggtaagctttgggtcgcggatacggcggcggatcagggccgtgttgaaaatcagggtttccacaaagccgtccctggaaccacgcatgaccttatccttctcaggctcgcttacccccctggaagggtaggtgcggcagtcgatggtgatacatttgtcaaagccgtcaataaacagacaggatacgccggacagaagctgggtaatcatgtccgtttcattggacagcaggccgatttccccatatgggacatactgtttggagaaggcgtgggcgtcctttggcatgtcctccggcttaatggtggagaagacctggaggatttttaagagggaatcatccttcgtaaatccatctataaaatataggcaggcctcgcggcctccgatgtggacaatacggtataccacatcaaaattcgtctggacattcagcttttcgtgaaggtgggtgatattgtcttttaaattttgggaaaattccattgtttattcctttctgcgcgacttcagatgaaaaaattgcataaagttagtatgcactgagtaaatgttattatacataagtacatttgtctttagagtaaagacaaatgggagaaatttatataaaaagaagctgacaggggaacgctttttgctaatgtgcacaaaaatcgttgacaaatcatggaaagggtggtatagtgtccatgtaagaagcacaaaggagtgccttacgggtttttgtttggtatggggatgccagataaactaatagtgtgacggttttgatcgtgactgagagctgccttctgtgggggaagggcagctccctttttttgtttatccggtcttatatgccggatttatccaaggcttcccgttcggatccgccttaagcctggcttcccgttcaggtccgccttaagcctggatttccgttttccataatccatgaaggttgcagtaggcgtaagcggccctgggcgaatctcctttttccaatgtaaagtgcgccaccggttcacaggacggggttaagcagacgcgcatggtgcagccggcctttgtgaccaggcagacccagccgatgttgtgtccgccgtccatgggatggaatatctcacccaccttcacggttacgtgaagcccctctgtctccaccaccggaagatgcttttcgctggcgccttccgccatgaccggctccagtacttcaaatggcctgcaggtatcgggaagggctgcattcggggcgctgcacagggcttctaacaccacgatgcggttcttatcagtgagaaatacaggttcctggttcaagtctgttttcatgtcaatcctccattctgaatttcagtcatgcaatatgttctgtatcaacatgcttatgtttccctgaaatggtgccggtctattcatacatgggataagtttctattgacatatttcctacaggaatagtatgataatcatatatggataattttcaccgcatctacaaacactaaaccaaaaggacgtgaatatacatgttagtatcaacaaaaggacgttatgccctgcgcaccatggtggacctggccatacacggggacggggagccggttaagattaaggatatagcaaaccgccaggggatttccggcaaatacctggagcagatcatctccatcctgtccagggccggctatgtgcgcagcatccgcgggaaccagggcggttattatctggctaagccggcagcagaatacacggtgggaatgatactcagggtgaccgagggaagcctggcgcccgtggactgcctgagcggcggcgagaatccctgcacaaggcagatggactgtgtgaccctcaggctgtggagggagctggacgaggccatcagcggcgttgtggaccgttatacgctggaggacctggtgcagtggcgcaggaacatgaaggataattatgtgatttgatgatgattgggaaatggcctgatcattagggagaggggataaaataaaggcagataatgggagcgggagaactttatgaaatggatcagacgtagttcggacttcattaataaatggaaaaaggacaggcgggtaagacttggcatcacactggcggctgtgatcatttcagcgctgatacagacctatgccctccaggtgtttgtccgcccggcgggcatcatctccggaggatttaccggtattgccatgctggtggagcgcctgggaggactgtggggagtggacatccccatgcagataaccatggtagccctgaatattccggtggcccttatgtgctgcaagggaatcagcataagattcactgtgttttccctggtgcaggtatttttaagcagtattttcctgcaggtatttaactttacgcccatatttaccgacgaagtgcttaatgtgatattcggcggggttatttttggatgtgccatcgtgattgccctcaggggcaatgcttccagcgggggcactgattttattgccctttttgtatccaacaggacagggcagtccatctggagctatgtattctttggcaatgcggtgatgtactgcttttacggcgccatatttggctggaagcatgccggatattccatcatcttccagttcatttccaccaggatgatatccgcgttccaccacagatatgaactggtcacccttcaggtcacgaccatgaaagggcctgaggtggtggaggcatatatcgggcatttccgccacggcatgtcctgtgtggaggcaatgggaggttatagtaagaagaaaatgtatctgttgaacacggtcctttccgcgtatgaggtaaatgacgccatccatgtgatgcagggcgcggatgagcacgtgatcatcaacgtgctgaggacccagcagtttgtgggaaggttttacagggcaccccttgagtaggggcgccctgacgccggaatggattttgaaacatatcctgccgtctggcggatgggggtcatgaaatcccgcatatatcccggacaatttcccctgccatcagaagaccggccacaggaggcacaaaggatatgcttccgggggttgcgcggcggctgcctgtatcctccccggatggcccgggtgtcaggggctgttccggggaccagcagaccttcaggttcctgatgtccctggcctttaactccttacgcatgatacggcacagggggcagacggaggtggccgagatatcggatatgcggagcagctccggatggagtttattgccggtgcccatggaagcgatgatggggatgccgtgttcccgggcataggatgccagggccagcttggctgtcacggtgtcgatggcgtccaggatgcaggcaatggacttggaaggagggagctgttccatgatggattcaaagagcgcgtccaggttatgggggagcacgaactgttcgctggtaatcaccagggtgtccgggcacatgtcagcgattttctccttcatcacaagtgtcttcgggcgtccgatggtactgtggagggcaatgctctgccggttgatgttggtaagcgaaaccacatcgttatcaaccagcaccaggcagccgaccccgcacctggccaaagcctccgccgcatgtgacccaaccccgccgataccaaaaacaacaacagcagaatccctaagccgtcccatgccatccccgcctagaagcatctcagttctggaaaattcatttatcatcatatcactcctaaaaacagcatattttcaaaaattgtacctcatatgaggaaaaaagtaaatgtaattgtcttccaacaggcaagaatagggggtatcttgagggaaaaaattatggtataatgtccgcgtaggcaatgagccatgcaaaataaggcaaagaaggatttctgttgtgctatacataaagaaatcctgtattggcttattttagagggcgaagcccgcaatccccgatggagcgtagcggaatcggggtgcatggcggaccggcggacccagtacccctaaaaaccaaagcgcctaccccacaaaaaaacacggaggccaaaacatgaaagacggattcatcagggcagcagcagtcactcccaaagtcaaggtagctgacccggaatataatgcacagcagatcatagaactaatcaaccagggcgcaagcaggggcgtgaaactcatggtattcccggagctctgccttacggcctatacctgcagcgacctgtttttccagacatccctgcttgcaaaggccagggaacagctttcccgcatcatcaaagccagcagggataaggatatcctggcattcatcggtatgccctgggagcgggacggcaagctctacaacgcagccgcagccatccacagagggaagcttctgggcatcatccccaagaagaaccttcccaattattcggaattttacgaagcccgccatttctgtcctggcaatgagcgcccggtattcgtatcatgggaaggcggacaggtccctatgggcatgaaccttctcttccggtgcagtaatctcagggaccttacaatcgcggtggagatctgcgaggacgtatgggtaccctgcccgcccagcatccgccactcactggcaggcgcaaccgttattgtcaactgttccgccagcgatgagacaacgggcaaggacgtgtaccgccatgaactgatctgcagccagtccgccaggcttgtatgcggctatgtctatgccaatgcaggcgaaggcgagtccacccaggacctggtattcggcggccagaacataatcgctgagaatggcacctgtctggtggaatccaggcggtttaccaatgaaagcatctgtgccgacctggatatggagcgcctggacagcgagcgcaggcgcatgagcacctttcctgccccggaagaagcccgcagggagggcggatacatgattgtggattttgaactgtcccttgacagcgctgtcaatgcaaacgcccagaccgtccaggcagacggcctgaaagaatccggcagggatgtcctgcgcttcattgacccggctccctttgtgccgggggatgagagacagcgcagccgccgctgtgaggaaatcctgtccatccaggcaatggggcttaaaaagcgtctggagcacacggacagccagcacgcggtggtgggcctttccggcggcctggattccacgctggccctgcttgtgactgtccgggcctttgacgcgcttaaattaccgcggaccaatatccactgcatcaccatgccgtgctttgggaccacggaccggacctacaacaacgcctgcgccatggcggccaaggttggggctgaacttagggaaatcaatatccgccaggccgtgagccagcattttacggatatcggacaggacatggacaaccacgacgtgacctatgagaacagccaggccagggaaaggacccaggtccttatggatattgccaaccaggtgggagggcttgtgatcggtaccggggatatgtcggaactggcgctgggctgggccacctacaacggcgaccatatgtccatgtacggtgtgaatgcgtccgtgccaaagacactggtgcgccacctggtccgctactatgcggatacctgccgggagaaagaactggcagatgtgcttttggatgtgctggacaccccggtcagcccggagctgctgccgcctgaggacggaaagatttcccagaagacagaggatctggtcgggccttatgaacttcatgacttctatttatattatatcctgcggtacggctatgccccgtccaaaatctaccgcatggcggtacaggcattcagggggcagtatgacaatggaatcatactgaagtggatgaaggtattctaccggaggtttttcagccagcagtttaagcgttcctgcctgccggacggacccaaggtgggttctgtggcagtgtcccccagaggggacctgcgtatgcccagcgatgcatgcagcaggctttggctggaggagctggagaaactgggctagagcgtggatgatcaggaaataacagatacaggagaaaaattatgataaacagcacggccaataaacaggtaaagcgtgtggtgaatttaaggaacagggcaaaggcgcgcagggaggaaggcgtgtatgtggcggaaggactgcgcatgtgccgggagctttcgataaaggacacggaaatcctctatgtaacagaaggttttgcaggcgaccgggagaaccgtaagtggatggatggattccggtttgagatagtaacggatgtggtcatgaaagtgatggcagatacccagacaccccagggcgttctggccgtggccagacagaaaacatacacgctggaggatatactgaaggctccccggaatggaaagctggcaatcatggttctggaaaccattcaggatcccggaaacctcggaaccatcgtaagggccgcggaaggcgccggcattacaggaatcgtgatgaaccgtgaaaccacggacatctataatcccaaagtcatccgttccaccatggggtccatatgcaggatgccgtttgtctgtgtggatgatatccgccaggcatgccagactatgaaagacagcggtgtgcgtctgtttgcggctcatttaaagggaatgaataattatgaccaggaagattatactgacaatgtgggctttttgatcggcaacgaggcaggcgggctgacagacgggacagcggccatggctgactgctatgtgaagattccgatggcgggcagggtggaatccctgaatgcggcggttgccgcgtccgtcctcatgtttgaggctgcaagacagcgcaggaaccggaaagggtaggccggctatgccatagacgcccacaggaaggaggacaatgcatggcatcacttggatggcttgtatcatttctggtgttcatgggcgtggagatggtattttgctgccttacctcgctgtggtttgcagtgggtgcgctgggggcctttgcggtggcccttacgggcggttccatggaacagcagctggcggggtttgtggcagtatcattccttacgctgattcttatacggccagtggcattcttgatgggcagacacgtaaaggacgggcagaaatcatgaaacttcagctggatttaaacagggaatacggcattgtactggagggcggcggggccaagggcgcctatcaggtaggcgcatggcgcgccctccgggaggccgggatcaggataaagggtgcggcaggcacctcggtgggcgctttgaacggcgcccttatctgtatggatgattttaagaaggcagagcgcatatgggaaaatatccgctactccagggtgatggatgtggatgatgaaatgatggagcggcttaagaagttcagcctccgcaggatttccagcatcacatccctgaatgtgggggagcttatatccggaatcaagcggatcctcaaggacggcggatttgacattgcccccttaaagggactgattgaggatgtggtggacgaggagaaaatcaggaactcggacagggagctttacgtggtcacctattccctttcagaccgacagcctttaatcgccaatgtaaaggaggcgccggaggggaccattggcgacatgctcatggccagtgcatatttaatcggtttccgccaggaaaagctggggggcaaatactatatggacggcgggggtatcaacaacgtgcctgtggatgtgctgatagataaaggatataaggatatcatcgtgctgcgcatctatggatacggcattgatacggagaaaaagctggaagttcctgaggacgtgaacctgtaccatgtggcgcccaggcaggaccttggcgggatattggagtttgacaggaaacgggccaggaggaacatgctgctgggctactttgacggcaagcgcatgctttacggtctggcgggccgggtatattatattgacgcgccggagggcgaaccttattattttgataagatgatgtcggagattccctgccttttgtcctatctgaagcctgaatatccagctacaggccgcagcggtcagggggatacggcccagtccgatgaactgccgggctaccgggtgtatacggaaaggattttcccgcagctggcaaaggaactgaagcttaaggacggatgggattacagggaactgtatctttccctgctggaggacctggcaaaacagtaccgtatcagccgctttaaaatttatacggtggatgaacttctgaacctgattcacagaaaagcggggagcgctgcgctgaaagcattgattcccactcttgacagcagcccgcaggtgtagtatattatgcataaagatgcataaatattaatagaatacagccatatgcagtggtgggagacggaggacattatgaatttaaagggaagacattttttaacgctgaaagattatacaccggaggagattacatacctgctggacctttcagcggaattgaaggagaaaaagaaaaagggagtcctgacagatacgcttaagggaaagaatgtggccctgatatttgagaagaccagcaccaggacccgctgcgcatttgaggttgcggcccatgacctgggcatgggtaccacctatctggacccgtccggttcccagatcggcaagaaggagagcatcgcggataccgcaagggtcctgggacggatgtatgaggggattgagtaccgcgggttcggccaggagattgtggaggagctggcgaaatacgcaggagtgcctgtgtggaacggccttaccaatgaggaccatcccacccagatgctggcagaccttctcaccatccgcgagcacctgggacatttgaaaggcgtaaagcttgtgtatatgggcgatgcgcgctataatatgggtaactccctgatgattgcctgcgcaaagatgggtatgcactttgttgcatgtgcgccggccaagtatttccccgacaaggcacttgtggcggaatgtgaggcatttgcaaaggaaagcggcggttccatcaccctgacggaggatgtgatgaccgcaaccaagggagcggatgtgatagatacggacgtgtgggtttccatgggagagccggacgaggtttgggaagagcgtatagaggaactgaccccctacaaggtgacaaaggctgttatggataatgccggacccaaggccattttcctccactgcctgccttccttccatgacctgaagaccaagattggccatgagatgggaacgcgctttaacgtatcggaactggaagtaacagacgaggtatttgaatccagccagtccgttgtgtttgatgaggctgagaacaggatgcataccatcaaggctgtaatgttggcaacgttaggagaatagcacatatgcatgggcaaagaggaaggggtgagcgccatgccgggatattcctggacatggcccacctgatactggggattgcgattataatccttgccgtgctgtcattcattaacccggagggaaaccatatgctgttccctctggtgtttttgctggcagcattattaaacgctgtaagcggtgtatttgaatgtaagacctggggacgggataagaagaaacgccgccagggcatattgcagctggcgctagccgtgggactggctgtccttggcatcttaagcgccatcagtatctgggcgtaataccgggaacagaccttcccacataaaagaggtggcagatgaagtcggagattttaaacatgctgagggccacgggcggttacctttccggccagcagctatgtgaacatttgggggtctcccgcacagccgtgtggaaggccgtcaatgatttaagggaagaaggttatataattgaagctgtccgcaacaggggataccgccttgtggaggatgcggatgtgattacccaggctgagcttaaatccatactgaaaacaggctggattgggaacaggctggaatattttgatgaaacggattccaccaatacaagggccaggaagtttgccgaggaaggggcgccccacggcaccctggtggttgctgacagccagtcctcgggaaaaggacgccggggcaggctctggacatcacccaggggcgtgggaatatggatgagcatggtgctgcgtcctgacattgcccctgtccatgcatccatgctcaccctgattgccggaatggcggtggtacggggcgtgaaggagagcacggggctggatgccatgattaagtggcccaatgacgccgtgctggcaggcaggaagatatgcgggatccttacggagatgagcacggaggatgagtccatccgttatgtgataaccggaattgggattaatgtcaatattgatgaatttcccaaagaaatccgtgacaaggcaacttccttaaagatggaactgggaaaaagcgtcaagcgcagccctgtgatccgggcggtggccgaggcatttgagacttattatgatattttccttgagacgtgtgacatgtcgcgtctgaaggaggagtataacagggaactggccaatacgggccgggaggtactggtgttggaccccaggggacagtatgaaggtacggccctgggaattgacgatgaaggaagccttcttgtgaggaaaaaggacggtacggtggtgcctgtcatatccggggaggtgtcggtaagaggtatttatggatatatttgatacagcgcatttgtatgacggcctccaggtcatggagcgggagcaggccccccttggcagggaggaacgtcttaaggccatggaaaagccgctgctggcctggtatggcagcagggcacgttccctgccctggagggacgacccgaagccttaccgggtatggatatcggaaatcatgctgcagcagaccagggtggaggcagtgaagccgtattttgagcgttttatgaaagcattccctgaggtccgggacctggccggagcggaggatgattaccttatgaaaatgtgggaaggccttgggtactataaccgggccaggaaccttaaggcagcggcccggatggtgatggaagaatacggcggctgccttcctgcatcctttgaggaactgataaagcttcccggaatcggaagttacaccgcaggggccattgcatccattgccttcgggattcccatgccggcagtggacggcaatgtgctcagggtcatctcgcgggtgctgggggaccggggggacatcaggaaggcttcggtaaaggcagggatggaacaggaactgaaggccgtcatgccctccggggatgccagccgctataaccaggggctgattgagataggggctttggtctgtatcccgggaggggaacccaggtgcggtgaatgtccgctggcatccgtgtgcctgacgcgcaggaatggatggtggaaggaaatcccttataaatctccaaacaaggcgaggaaaatcgaggaaaggaccgttttcatcatagaatatcaggataaggtggcaatccacaagcgtcccatgaacgggcttctggcagggctttatgagtttcccaatgcctgcggccatccggatgcggatgagatacctgcggtattgggaatgaatcccggatgcataaaggccgttaccccgcttcccgctgcaaagcatgtgttttcccatgtggaatggcatatgacaggatatagggtggtggtggatgaggctgccgcggatccggtgtttcctggcggacgggaagagagaaaaggtgtggcggatgaggctgcggccggggactggttctttgtttccagggaacagctggcttcctcctatgccattcccaatgcatttcaggcctacacggcattggttggataagtttgtcaaaattggttacaatgaaaaggaggaatgatggatgaaaaaaatgctgtttgtttttaatccccgttccggcaaggagcagattaaaggtcatctgatggaaatcctggatatcttcaccagggcgggctatgaaatccgcgtccatgtgacccagaaacagtctgacgcggtggaggttgttgccagatacggcaaccgcgtggacgtggtggtgtgcagcggcggggacggcaccttgaacgagaccgtgaccggaatgatgaagcttaagaaactccccatgctgggatacattcctgccggttccaccaatgattttgcatccagtctggaaatccccaaaaggatgccccaggcagcggcagatattgtggagggcatgccctttgccattgatatcggaaccttctgccatgacaggtatttcatgtatattgcggcctttggggcatttacggaagtgtcctaccttacctcccaggacaggaagaacctgctgggacaccaggcctatatgctggagggggttaaaagcctggccggaataaagccctatcacatgaaggtggaatgggatgaccaggtgctggaggaggactttgcttttgggatggtgaccaacaccaggagcgtggggggattcaaggggctggtgaaccagtccgtggcccttaacgacggcatgtttgaggtcctgctcatccgcatgcccaggaccccggtggaccttagcaatattgtttcctatatgttcctgaaggaagaacccaatgaatacgtatataagtttaagacagcgtccatccgcctgacctcggaatggggcgttgactgggtactggacggcgagtacggcggcaccaggacagaggtaaatattggaaatttgaaggaacggatacggatactccttaaaaaataaataaaatgtcgaaatatgttgaaatacagtggcgagtggtatataatgataagttgtgggagtctccacatttacctttaagcgaaaggacgtttatcagtggaaaaggacgattttttaaagaagctggaaaagctggtcgaacatgcaaaatccaagcacaacacgctggatgcaggggagattaatgatttttttaccggggataacctgtcaccggaacagatggaccaaatttacagttacctggagaaccgtaatattgacgttgttcccgtactggacgaagcgatgcttaccgaggacactgttctgcttgatgacattgatttagacctggatttagacgacgacagcttcattaaagatgcagaagaggaagaaatcgacctggatgcagtggatctgttggagggtatcggtacagaagacccggtccgcatgtatctcaaagaaatcggcacagtgccccttcttacggcagacgaggaattaaacctggcccagcgcaaggctgacggcgatgattatgccaaggagaggcttatcgaggccaacttacgtcttgtggtcagcattgcaaagcgttataccggcagagggatgagtttcctggatctggtccaggaaggcaatctgggcctgattaagggcgtggaaaaatttgactatacaaaaggttataagctaagtacatatgcaacatggtggatccgccagtcggttacaagggcattggcagatcaggcgaggaccatccgcgtaccagtgcatatggttgagacgattaataagatgtccaagatgcagaggaagcttaccctggaacttggctatgagccgtcggtgacagagctggcagaggctctggacatgaccgaggacaaggttatggaaatcatgcagattgccagggaaccggcatcactggagacaccgattggtgaagaggatgattccaacctgggcgattttgtggctgacaataatgtggtgacaccggaaggcaacgtggaatccgtcatgctccgcgagcatatcgatgcacttctgggcgatcttaaggagagggagcgccaggtcattgtactcaggttcggactggaggacgggcatccccgtaccctggaggaagtgggcaaggagttcaatgttaccagggagcgtatccgccagattgaggccaaggcattgcgcaagctgcgcaatccggtcagaagcaagagaatcagggatttcctgtaattgataggtaggtcagggtggagaggtcgtttggcaggcggcctctttttctggtgtacgcgtactttgcaggtttgtctggatgtgttccgggggagcggaaccggattaagtcataaggaggccagggatggcgcaggacggtcagaaacggaattatcaaaaagagatggaagggctgatggaaggatttaagcgggaagggaaaaggcccagcctgctgctgcacagctgctgtgcgccgtgcagcagctatgtcctggaatacctgtcccaatactttgatatcacggtgtattactataatcccaacattgccccggaaaaggagtatgaggcacgggtaagggagcaggaacgccttataggggaaatgaaggttcctggtccggtccggttcatggcaggggaatatgtgccggaagatttttacgcggctgtcaaagggtatgagaaggtgccggagggcggggagcgctgtgttaagtgctttgagctgcgcctggaacatgctgccgtaatggcaaaggaaggcggttatgactattttaccaccaccctttccatcagccccatgaaaaatgcagccaggcttaatgaaatcggccagaggatgtcggccctatatggcgtgccatatctggtatctgattttaagaagaaaaacggatacaagcgttccgtggagctgtcaggggaatatggcctttaccgccaggattactgtggctgcgtgtattcccaggcagaggccagggcgcgcagggaagcggcagaggcgtccggccgttcttgatccgtccgtatggaaagcaggttacaggcgtcttctggattgtgaaaaagttgcttaggattttcccgattaacttgacatagacaggcagatgtaatagaatctttcataggagacattgcgcaagacggtgtcctgggagtatgtccgtatcatgggatattctttcaaatgagtataaaatagtgaataaggagagtgtattatgatcagtaaaacattaacagttattaatccatccggtttacacttaagaccagcaggagtcctgtcccagacagccatgaagttcaagagcgatattacgattgagtgtggggagaagaaaatcatcgctaagagcgtactgaatgttatggcagccggtattaagagcggaactgagattaatctgatctgcgatggcgaggacgaagaagaggctatgaagaccctgaccgaggcaattgagagcggactgggtgagatgtaagcttagatgtaggattattttgaaggttatatttaggattatatattactgcggtatggcattgaatctgccataccgctttttctattgggttcttttggtgaaatgtccgatgcatggtcagatacacttcctggacgctgtattgccacggttcctgctgcctgtcatttcctgagaaaacaaggcgaggataaaacatctgatgtcagttgcatttaattgcttgaagtacggactccacgcttctgtccaactcaaggttctctatcctgagtaccggacatgtaactgttttcagccacgcctcatgtttggccaggcttcttccggacctgcttcctgaatcataggaggatgcccactctatgaattcggcagaggcctggtgcctgctgtttccgggcaggattgcatcgccgtaccgctctgcttcccgtctttttagccgttctatccgtatgtccgcgggaacgtgtacaaatacaaccaaatcaaatatagatgccagttcatcataccacccggtcacggagccgctgagcacccaatgggggctgctgtttaaatcgcggtccatcagggccgcgtaatcctcgtgtctgcgcgtgactgtaaaaggggcctgggtgggcaaccagaaatagctgtccgagtcaaaatggctgtagcctgtgtgttcacatactttttctgcaatcgtcgtggtgcctgagccggaggcgccgaatatgtggatgtgctttttcataagtccctcttttgtggtgcggatgctgaaaatgtcaggtttctgtgtatacgtaacgatataagtatatcacagatgtagggaatatgtatgaaaagtccattgaaaatgcatggaaataaagtgatggatatgtatgcacaaaaatgaaaattctattataatgataaaatatgacagataatataacatgggaaatattagttatcgaattatctgacaattacagataaaaacttatttacaaaaagaaaaaattgtagtatcatcaccactataaaaaacaggcggaagttcccccaggatatgtccccccagacactcccttccgccaaaagaaaggaagtatgcttatggattccaaacagaaacaaccaggactgtacgacccgcgttttgagcatgacaactgcggaatcggggcggttgccaacatcaaaggcatcaagacccatgagacagtcaatcaggcactccacatcgtggagaatctggagcacagggccggcaaggacgccgagggcaagaccggcgacggcgttggcatcatgcttcagatttcccaccgcttttttgaaaaggtgacacagcctctgggcatccatatcggtggcgagagggagtatggcgtgggtatgttcttctttccccaggatgagcttgcccgcaaccaggcgatgaagatgttcgaaatcatcgtgaagaaggaaggccttgctttcctgggatggagggtagtccccactaccccggatatcctgggagagagggccgtggaagtgatgccatatattgcccagggctttgtggccaaacccgcccaggtaaagcctggcctggattttgacaggaagctgtatgtggtgcgccgggtgtttgaacagagcaacgaggatacatatgtggtttccctgagcagccgtaccattgtgtataagggaatgttcctggtgggagagttaagacggtttttcgcggaccttcaggatgaggattacaggtctgccattgccattgtccattccaggttcagcaccaatacaaaccccagctggatgcgcgcccatccataccgatttatcgtgcataacggtgaaatcaacaccatccggggcaatgcggataagatggctgcacgtgaggaaaacatggagtcggagtattttaagtatgacatgcacaaggtgctgcccatcatcagccaggaaggctctgactcggccatgcttgacaatgcgctggaattcatggtgatgagcggcatggacctggccctggccgtgatggttaccattccggcaccctgggagtatgacaagtacatggacggcgagattaaggatttttaccgctactacgcaaccatgatggaaccatgggacggcccggcctccatcctgtttacggacggggatgtgctgggcgcggtgcttgacaggaatggccttcgtccttccaggtattatattacggaggatgggtatatgatccttgcctcagaggtgggggccattgacattgaccagacaaaggtggtgaggaaggaccgcctccgtcccgggaaaatgcttctggtggacacaaaaaagggcgagctggtggatgacgaacacctgaagcattattatgcgtcccgcaagccttacggcgagtggctggattccaacctgattgacattaaggagctgtccgtgcccaataagggcgtgcctgccatggaggaggaacagcgcctgaagctgcagaaaacctatggctacacatatgagcagtataagaccatgatcctgcccatggcgctcaacggggcggaggcggtgtcggccatgggtgtggacagtcccctggcagtcctgtcagccaagcaccagcccctgtttaattactttaagcagctgtttgcccaggttaccaatccgcccattgatgcaatccgggaggaaatcgtgacctccaccaccgtgtatgtgggcgaggagggcaatatcctggaggaagcgcctgagaactgcaagatcctcaaggtggagaaccccatcctcacggaaacagacctgcttaagatcaagaacatgaaaaagcctggcttcaaggtagaggaaatccccatcacctactacaagaacacgtccctggaaagggccattgaccgcctgttcctggaggtggaccgtgcccataaggacggggccaacatcatcatcctgtccgaccgggatattgatgagaaccacgtgcccatcccctcccttcttgcggtatcagccctccagcagtacctggtaaggaccaagaagcgcaccagtgttgcccttatactggagagcggggagccaagggaggtccatcattttgcaacccttctgggatacggcgcatgcgccatcaacccttatcttgcccatgaatccatccgctccctgatccaatcgggaatgcttgataaggactattatgcggcggttatggactatgatatggcggtgcttcacggtatcgtgaagattgcttccaagatggggatttccaccatccagtcctatcagggcgcccagatttttgaggccatcggcatttccagggaagtggtggacaaatatttcaccaacacggtcagccgcgtgggcggcattaccctggaggatattgcaagcgatgtggatacccttcattcatctgcatttgacccactgggactggatgtggacctgaccctggacagcgtgggaagccacaagtcgcgttcaggccaggaggagcatctgtataatccccttaccatccatctgctccaggaagccgccaggaccggaagttatgacacctttaaggaatatacggccgaggtggacagggatgacaagacataccatctgcgctccctgatggattttaagtttcccggggacggggggattcccctggacgaggtggagggcgtggactccattgtgacccgttttaagacaggcgccatgtcctatggctccatttcccaggaggcccatgagtgcctggcggttgccatgaaccggatccacggcaagtccaacacgggcgagggcggagagagcttggagcgtctggcgtctggccagggaaagaataacagatgttccgccatcaaacaggtggcttcgggacggttcggggtcaccagccggtacctggtgagcgcgcaggaaatccagattaagatggcccagggcgccaagccgggcgagggcgggcagctgcccggcaagaaggtgtatccgtgggtggcaaagacaaggcattcaaccacgggcgtcagcctgatatcgccgccgccccatcatgacatatattccatagaggatctggcccagctgatatatgatttgaagaattccaacacaaaggccaggatatccgttaagctggtgtctgaggcaggggttgggacagtggccgcgggcgtggccaaggcaggggcccaggtcatcctgatttcctcttatgacggcgggaccggggcggcccccaggaattccatctataatgcaggtcttccatgggaactgggcgtggcggaagcacaccagtccctgatcatgaacggcctgcgcgataaggtaatccttgagacggacggtaagctgatgacaggcagggacgttgccattgcctgtatgctgggcgcggaggagttcggttttgccacggctccccttgtgaccatgggctgcgtgatgatgcgcgtgtgcaacctggatacctgccccatggggattgcgacccagaacccggagctgcgtaagcgttttaaaggcaaaccggagtatgtcatccatttcatgaagttcattgcagaggaactgcgggaatacatggctgccctgggcgtgcgcaccgtggatgagctggtgggacgcacggaccttctgtgcaccaaggatgggacgccctgcggccgcggcaggaaggtggacttaagccgtatcctggataatccttatgcagggcagaaggtggcaggataccatgagaagcaggcctttgactttaagctggaggacaccattgatgaacaggttttcttgaaaaagctgaaaagcgcccttggcagcgggcagaaaaagagcgtccaggtggatgtctccaatgtgaaccgtacccttgggaccatttttggctcggaaatcaccaggaagtacccggaagggcttgatgaggatacatttaccatcagctgcaacggaagcggcggacagagttttggagccttcataccgaagggacttaccctggagctggtgggggattccaacgattacttcggaaaggggctgtccggcggcaagctggtggtgtacccgccgaccggcgtccagttcagggccgaggacaacatcatcattggaaatgtggccctgtacggggcaaccagcggcaaggcgttcattaacgggattgcaggcgaacggttctgcgtgcgcaattccggggccaccgctgtggtggaaggcgtgggggaccatggctgtgagtatatgacaggcggatgcgtggtggtgcttggaaccacgggcaagaactttgcagccggtatgagcggcgggattgcctatgtgctggatgaggagcgcagcctgtataaacggttaaacaaggagcttgtatcctttgaggaagtgacgaataaatacgatgtactggaacttaagggactgatccaggagcatgtggcgtataccaattcagagaagggcaagcgtatactggaccatttcagcgaatacctccccaggttcaaacggattgttccccatgattaccgccgcatgatgaatgcaatcgtgcagatggaagaaaagggattaaacagtgaacaggcgcagattgaggcattttatgccaatgtcagaggataaggaggtgggacatcatgggaaaaatgacaggatttttagattatgaacgggaagtaagcgctgaagaagctgccagggacaggataaaaaactggaatgagttccatattcccttaagcgaggaggaacagaggaaacagggcgcgcggtgtatggaatgcggcgttcccttttgccagtctggcgtcatgatgaaggggatggtaagcggatgcccgcttaacaacctgattcctgagtggaatgacctggtctatacaggcaactggcaggaggcatttaacaggcttaaaaagaccaacagtttcccggaattcacgtccagggtctgcccggccccctgcgaagccgcctgtacctgcggcctgaacggggacccggtgacggtaaaggaaaatgaacgggccatcattgagaaggcctacgatatggggtatgccctgccaaagccgccctccatccgcaccggtaagaaggttgctgtgattggctccggtccggccgggctggcagctgccgaccagctgaataaaaggggccactcggtgaccgtgtttgaacgcagcgaccgggtgggaggccttatgatgtatggaatccccaatatgaagctggaaaaatgggtgattgagcgcaaggtggaggtgatgagggcggaaggcattaccttcatcaccggggcaaatgtgggaaagaattataaggtgaaccggatcatgaaggaatatgaccgtgtcatcctggcctgcggggcatccaatcccagggatatagacgtgccgggaagggacgcccaggggatttattatgcggtggacttcctgaaggctaccaccaggagcctcatggattcacacctggaggacgggaactatatcacggccagggataagcatgtggttgtcatcggcggcggggacacgggcaatgactgtgtgggtacctccatccgccacggctgcgcatccgtgacccagctggaaatgatgccaaagccccctgtgaaacgggcggatgacaacacatggccggagtggcctaaggtccttaagactgactacggacaggaagaggcaatctgtgtgttcggcgatgacccaagggtttaccagacaacggtgaaggagtttgtgaaggatgcagagggccgggtgtgcaaggctgttatctgtgaccttgtgccgagaaaggatgaggggagcggccggaccttcatggcaccggtggatggcagcgagcgggaaatccctgcggacctggtgcttatcgctgccgggttcctgggaagcgagacatatgtggcggacgcatttggcgtggagctggatgggcgttccaatgtggctgtgaaagacggttcttaccagaccaatgtggaccgggtgtttgcggcgggcgacatgcaccggggccagtccctggtggtatgggccatcagggaagggcgcgaggtggcgaaggccgtggataagagcctgatggggtattccaacctggcttagggtgtgtttggaaattgctttccgtcagctgtgcgtcccactttgtgggagatttggcacaaatgaagggcgtatagcgggctatgtaacctgaatttgggccaaatatgccgcgaagtggggcacgcagatggcgggactggattttaaaacacgccctgggacgtggccctgacagtggtattcagatggattggttggcgcccggcggcggggattatctgcgtcatggaaatggcggggatggttccttgccgccgggcgttttcctgtccgatatcctttgtccggtatcctttgtccggtatcttctcatccggtatccagtgaatccggggttcttaatatccccggcttttcattctgtcatatgcagggaagaacggctgccctgacagatgttccggcgcgggagcgggaacttgacttgacatgtcttgaaaccgcattataattaataggagaaagtaaagtacgctgagtgtgtaggaatgtgagggaagtatggaaggcaataaacgggtatccattatagatgtggcaaaaaaggcaggggtttccatagcaactgtctcaagggtcattaacaggaacggtgggtattccaaggagacggaggagcgggtcaggaggaccatagaggaatgcggctttactcccaacgtcaatgccattggtctgaggaccaaccgcagcaacagcataggcgtgatcgtgcctgatatcaccaatgagttttttgccaggatcatacgggaactggatgcattcctgctcagcaggcgctattccctcctggtgtgcaattccaatgaggattatatgctggagaacatgcatattaagggtctggcggaaaagcatgtggacgggatcatatatatatccggtcagaatgaaatcaagaagatgaatgagattaagggcctgcccatcgtgtatatagacagggcgcctaagaatgcggaggtgctgatcctgtcggataatgagaccgggggatacctggcgggccgtgaactgatacagaagggatgcaggcggatcctgttcctgagggatatccgttacgcctccactgtgcgcagccgtaaggaaggatttgtgagggcgcttcaggaaaagggaatggccttcagcgaagagctggagatgagctgtttccctgaatatgcagaggccagggttgtgctggaacggcttctcaaggaaaagggatgcttttttgacggcatattcgcaaccaatgacatgatggccctggcctgtgtcaatgtcctgacggagaatcagattaaggtgccgggccaggttaaggtggtggggtttgataacatttccctgacccagttcacaagcccccagataaccacggttgcccaggacacaaaggagctggccatccatgcggcggataccattttgaagatgatagaggatgaggagataaagcagaagaggacaatcataccggtcaggctggttgtgagggaaacaacctgacggaagtgcggcagggacaaggcggctgggacatagcggttgggacaaggtagctgggatatggcggctaggaaatagtggtgagtactggaaaaccttttcattacggtgaaagggttttttattttacgtaaagagtaaacgtttaccaattataatataaaatatgcacaaaaaatatagtaaaaaatcgttaaaatagcagaaataaacatttatacttgactttttatacgtaaaggtttactatacagtcacgagatacgaaaacctttacgtaaagcaaggaggcctgccatggatggtaatgcgaagctctctattgtggacgtggcaaaacgtgcaggggtttcaaccgcaacggtttcacgggtcatcaaccataacgggggatactccagggagacggaagaaaaggtgcgccggaccattgaggagtgcgggttcacccccaatgccaatgccatcggcttaaggaccaacaagagcagatgcatcggggtgattgtgccggatgtgaccaatgagttttttgccaaaatcatccaggagctggatttctatctgctgaagcatgggtattctcttctgatttgcaattccaatgaggattatgagctggaaaacatgcacatcaaggggctgatagaaaaacacattgacgggattgtatacatatcaggacagaatgaaatcaagaacatcaatgaaatcaagcatatacccgtggtctacattgaccgcgccccgctcaatgccaggatgctgatcctgtcggataaccaggagggaggctacctggccactaaggagatgattgacaagggctgcagacggatcctcctgcttcgggacgtccggtgcgcctcgaccatccggtaccgcaaagagggatacataagggctttgaaagaaaacggcatcccctacagggaggaactggaggtcagctgcttcccggattatgcggaggcaaggaaggtgatggatcggctggtccgctccggcggctgttactttgacggcatatttgccaccaatgacatgatggccctggcctgtatcaatgtgctgatggaagcagggattaagataccggagcaggttaaggtggtgggatatgacaatgtttccgtcaccaggttcaccagccctcagataaccaccattacacaggatacgagacagatggcaattgcggccggcaggaccatactgaggatgatacagaaaaaggaaatcagcgagaagcggaccatcatcccggtgaagctggaggtgagggggactacctgatagtccgtgtgcggactgccggtactggtctatcaaccggttctgcggttcccggtacaacataaggggaaaagaggaggatttatggagacattagtaaaaatggaaggagtcacgaaggtgtttcccggagtcagggccttggataacatttcgtttgaaatcaaggcaggagaggtgcatgtgctcatgggggaaaacggggcagggaaatccaccctgatgaagatactcagcggcgtataccagcccacctcaggtaagattacggtaaagggaaaggaattcacacacctgaccccgaaggattcctatgaatgcggcatcagcatcatctaccaggaactgagcgtcatcaatgagctgtccatcctggagaacctgtttgtgggaaagctgcccaccaggcgggtgggaggcatccgggtggtggactataaggggatgacgggcagggcccaggaggtccttgacaaggtggggttaaaacgcaggcccagccagctggtggaggaaatcagcatatccgaaaagcagcagtgcgagattgccaaggccctcatatccaatgcggacgtcatcatcatggatgaaccgacctcttccctgacaacttctgagacagcccacctgttcgatatcatccgccagctgaaggcagagggcaagggaatcgtgtatatatcccataagatggatgagattaaggaaatcggcgatgtgattaccgtgcttaaggacggcacctatgtggggaccaggaatgtcaaggagataacgctggatgatgtgataaagatgatggtgggacgcgagatcaaggggacctaccacaatgaggagatagaggatttcagcaaagagccggtcatctttgaagccaggaacatcaaccggaaggacggcaaggtgcgggatgtgtcctttcaggtgaggaagggcgagattgtgggctttgcaggacttgtgggggcagggcgcagcgagcttatgaacgccctgttcggggctgaaccaaagctttcgggacaggttttcatcgggggccgggaggtgaccatacgctcgccttatgaggccatcaagaacgggctggccatggtgacggaaaaccgcagggagacgggcttcctgaataatttcagcatcaaacagaacatttccattgtccccttcctcaagacatccaggggaaacgggttgatcggcctgctggataacaaggcggaagaagaatatgcggcaaaacagaaaacggacatgaacatcaagtgccgggacgtggagcagaacataacggaactgtcaggaggcaaccagcagaaggtaatactgggaaaatggatggcggctgaatccagcgtcattatctttgatgaacccacaaagggaattgacgttggaagcaaaagcgagatatacgtgctgatgcgcaggctggccagccagggaaagggagtcatcatggtgtcctcggagatgccggagctgctgtccgtatgcgataccatctgtgtgttcagggacggcgagatacgcatgacctacgcggtcagggaagcaacagaagaaaaaatattgaaatcatcaaccggtgaagagtgatcaggaggggaagaaccatgaataatcagacggaagtaaagacaaaaccaagtttcggggtgctttggcagaaatacggcaccatgggcatattcctgctgctgctggcagtgcttaccattgcaaagccgtccagcatcttcaaccctgacagtatcccgcagatactgaagcagagcgcggtgaacatcctgctggccctgggcgaattctttgccatcctcattgccggtatcgacctgtccgtgggcgcggttgcagggctggtggggatgctgacagccatgctgatggtgaacgggatcccggtaatcccggcgctcctgctgggaatcctcattggcaccatgatcggtttctgtaatgggatgctggtgaataagacagggcttcatcccttcatcatcacactgggcacccagtccatattccagggcctgatgctggtcatctcggattccaggaacatttacgggttcccggcatcctttacaaagaccatgagcgccagcatcctctacataccggtgcctgtcatcattgccttgatcgtggcagccgtctgcgccttctttaccacaaagtgcaaggctggccgcaatatatacgcccttggaggcaatatggaggcggcctggtactcaggcgtcaatgtgaatcttcacaggcttctggtgttcatgatttccggaacctgttccggtattgccggaatcgtgcttctgggccgtgtgggcgctgcggcacccaccgcaggaaccggatacgagacatacgccattgcggcaaccattatcggcggcaccagcttcatgggcggcaagggtaagatactgggggttgtgatcgggggcatgattatcggtatcatcaactatggcatgacggccctgatgattcccagcagttaccagaagatagtgatgggcgccctgatcatcatctcggttgccatcgaccattttgttgccaaggcaaagaactaaacaggaggacaagattatgaaaccaatgtttaacccttccctgatgtgcatggacctgcttaacatcaaggaacagcttcagatactgaatacaagggctgatttctaccatgtggatatcatggacggccattatgtaaagaacatcacattgtcaccggatttctgcaaggccatccgccctgtgtgtgagattcccctggactgccacctgatggtgacgacgcctgatgattttattgaaccgctggcaaaggcaggagtgggttacatatgtcctcatgcagagaccattaacgcggacgcgttccgcatcgtgaataagatccattcccttggatgcaaggtgggggttgtcttaaatccggctaccccggtgtcctatatccagcattatatccatctgctggacaaagtaacggtcatgaccgtggatcccggctttgccggacagccgttcatccgtgagatgctggacaaaatcagtgagctgaaggccctgaaggaggaaaaagggtacggctacctcattgaagtggacggctcctgcaatgaaaggaccttcggggacctggcaaaggcggggacggaggtatttatcgttggcacatccgggcttttcaacctggataaggacctggcagctgcctgggataagatgatggataattttaataaagctgtggatcggtaaggtggggacattatgggacaggtaataggaattgacatcggagggacgaatctccgtcttggctgtgtgtcggcagacgggcagctggagcattttgaaaggaaatcaagcgcccccatgctaaaggaaggcgcggtagatgtcctgtgcggggaaatcggggactacatggaacggcatttcctcaacggctgtatagacgctgtctcagttggggtcccgtctgcggtcagcaaggacaaaagctttgtgtattccacacccaacctgaaggggcttgagaatatcgaccttgggcatcttctggaggaaaaactgggaatcagggtgttcgtggacagggatgtgaattatcttctgtgccatgacatcaagaaatacaacctggacccggagcgggataagaccatactgggcatgtatctcggaaccggattcggcaatgcaatttatgtcaacggacgtttccacgcagggaagaacggggttgcgggggagctgggacatatcccgttcttccatctgaaggaaacatgcccctgcggaaatgtgggctgcgtggaactgcgctgctccggcgcccatctgcagaggatacgcaaccagtattatccggacacggaaatcggggacattttcacaaaacatggggatgagccggccatacttgagtttgtggaggggctggcatacccaatcagcacggaagtgaccatcctggacccggattatgtggtcatggggggcggcgtcatgatcatgaaggatttccccatggaatatctgattgagcaggtgaaaaaaaggacgcgccatccatatccgtcggagaacctggaattcatattcccggagcacacccagacaagcggggtggccggaggcggactggctgcatttgacgccatgaagcggcggcgttaaaggttttaagacagtgaaaacagcaaatccacgtctgtgcaggaggctggtactgcttccatgcaaggacgggaaaataaaaaaacatatgtataaaggagaggtaaaaatgaagaaaagaatgttagcagcagcactttcagtggtaatggcagtaggcctgtcagcatgcacatcaggcgggaatgccaccacggctgccccggaggccaagacagaggcggcaaaaacagaggaagccaagacagaggaggccaagacggaagcggaggccaaggaagccgcggcaggtgtcagcgataagaagtatgcggtcatcttaaagacccaggccactgacttctgggtaaagatgtggaagggcgtggaggcggaaaccgctgtaaagggcgtgaaggtggatctgtattccgcacagagcgaggatgacctggagggacagcttaccatcctggagagctgtatccagcagggatatgacggaatcgccattgcccccctctcaggcgtgaacgtgctgcctggtatcggggaagcgacggcaaagggcatcaccatcgtggatgtggatgagaagtttgacgagacagagctggcaaaccagggcggcgcatgcgtggcattcgttgcaacggataatgtggcggtaggagccaagggcgcacagtacattgttgatacggcaggcgagggcgcaaaggtggctatcatcgagggtaagtcaggcaaccagtcttccgaggacaggacccagggggcaaagcaggcatttacagatggcaagatggatatcatcagcagccaggcggctgactgggaccgccagaaggccatggatatcgcctccacgctgatccagcagaaccctgacttaaaaggcatctactgctgtaacgacggcatggcacttggcgctgtacaggctgtcatcaatgccaacaagctgggggaaatcatgattgtgggtacggacggcgatgcggaagcagtgtcctccattgccaacaatgagctcagcgccacggttgcacaggacccggctcagatcggcgcaaccagcctggatcttctgattgaggcggttgaaagcggtaagaagggcgaggttgggacattcccggaaaagacaccggtggagtctgttctggttactgctgaaaatgcagctgatttccaataatgatgtgagactggcagggctgcagtggtaactgcggccctgcgcgtatgtacggaccgaatggacagaggataggagacaggatatgagagttggatttggtaatgaccatgttgcaattgaacttaaaaacattttgatgggacatcttagggataagggatatgaatgcattgatttcggccccacggacccggcggacaaggtgaactatccggagcccggacgcctggtggcggaagcgctcatgcggggggagatagacaagggagtattgatctgcggtacgggaatcggtatttccctggcagccaacaaggtgcccggcatccgcgcggccgtgtgctccgagccttattccgcaaagcttacggtggagcacaacaacgccaatatcatagccatgggcgcaagggtggttgggcctgaactggctaagatgattgtggacgaattctttggcgctgaatttgaaggcggaagacatgccgtgcgcgtggatatgatatctgcaattgaagcggaatatggggcgaagtggcatgaataggctggtgggcgttgaaatcggcggcacaaagcagcagattgcggtaggcacggcccagggggaaatcctggacaggaggacggtcaggctgggggataagaccagcgccggggatatccttatgtggctgaaggacaatatcctggaaatccaggagcggtgggaaatcggcggaatcggcgtggggttcggcggcccgctggagtttaagacgggccgggtcctgtgttcccttcaggtgccgggatggatggatttcaggctgaaggagtggtttgaggaacagttcggggtgcctgccgtcattgtcaatgacacggtcctgggcgggattggggagctggttcttggcaatggcgcagggagcagccgctttttctataccaacatcggcaccgggattggaggcggcctgtatctggacggcagatactatgacggctgcggatacggtgcctgttatctgggcaatacatgggttcctgactggagggacagcaggccgggggcaatgacaaggctggagcttatctgctccgggaaaagcattgagaagcggctgaacacgccgggatatgtggcaggggaatcctgcctggaaccagggaacgggtgggtgtcctgcgcggacctggcagagggggcaggggcaggggatttgttctgctgccaggaactggaccggattgcacggacgttttccctagggctggccaatgtgctggcaattgccgcgcctgaccggattgttgtgggcggaggcgtggccaaaatgggggacctcctgttttcacgcatccgcaggtatacacaggagtatgcctttgtggccgatgccggacattatgggattgtggaaagcaggctcatggatgatgccgtcctggccgggggcctcctgacggcagggaatcccgggctggcgcagtggggatgaaaccggaagcgctgtatgcgccgcacatcatgctgcggcgcatgtgcctgcatatagtctatatcaagactctattcaacgcaggtgatttatgttaatatatgttcactgaaggggctgcccttatcaattaaatctggatatctgtctgcattggttttcttatttctgtttatcattcccatgtatcattccacatttcatgttttatgaagtatcatcatcaagcgtcattccatgtcatcatatctgcctatctgtaaggaggaatatcgtgaaccatcctgccgtgtacctgcctgatccgtatctcaaaaccctggcggacagcgattgcccgctggacatttccctgaccaatgattttgccttcaagaaaacattccgtaacaaaaaagcacttaccggactgttaagctgtcttctggatatcccagccggacagattgcggacattgggtttcccgacacgttccttcacggagactatgtggaggaccatgagggaatcctggatatccggctggtcctgaatcatcggaagcatattaatatagaaatccagatgcatacctatccattctgggaagagcgctccctgttttacctggcaaagatgtatacggaagatttttgtaagggcgaggattactcatcccttaaggaatgcatacatatcagcatcctaggttttgatttggaacagaagaagcttttcagcgtaatccggctcatgggcgacaggaactgccgtgtttacagtagtaaactgagccttcgtgtgctatacttaaagcagatagaaaatgccactgaggaagaaaagcagacagatgtctacaagtgggccaggttgatatcggtccgcggctgggaggagttgaagcggatggcagggagtgatgaatatatgaacgcggctgtggaggagatggagaggattaacgccgataaggagttaaggtaccggtatctgatgcgggagaaggcggccagtgatgagacaacgatacggaactattatattcaaaaaggagaacagagggtaaaccggctgatacagatcctgcttgaaaactgccgttccgatgatatatgcagaatgattcatgataaaggacttcaggaaaaattatttgatgaattcggtttatgacaataacagacccaaagacagcttttcatgaaaaggctcatgaggagctgtttttttgataaatgccacatcagtttttatttgacggaaataggcaaaaactgtataattgagtaagaatttggaaaactgcggttggctgcggtgcgggagagggctatggttgcattaaaagtagaagatgtcaggtcatttacgtccaagctgtttgtaaaagaggactttgaccggtttcttgtaaaggaaatcaacattatcacttataacagttttacgattgacggtcatgtcagacagggatattatacccaggaggagctggaggagaaccggattgaggatttttcttcctggaaaatgttaaagcctctctgcttttccctgattaaaggaaaaaaacttcccggaagcttccatatcgtgttatcccttgccccacgggatgtggaaaagtttgcatcctccctgggcacgggaatagatggcagccagattcagggattgtatctgaatatccgttacgaagacggagcattatattgtataacgggaacttcgctgaacttttttaccctggacaagacactggaaacagagtgggataatgcggtaaaggcctttatgcgttcccatgagatagtgtgcacttgaggtaaggcaggtcccatatgaggggggagggcaacgtatggataaaatggaattgtctcgtaagctggaacagctggctgcattggccgcatccagggaaaaccgcctggagatgacggaggtgctggatgcatttaaggaacttcaggtgacgccggaggagatggaggacgtttaccgcaagctggaacggaaaggcgtccagatccaggtgccggaggagggggaggaaaccctgcctgacagcgacctgatcctggaggatgacctggccctggaggacggggggatggtcaaggaggacttccgctggaagttcagggacagtgattcggatgatttggatgagggcggtttagggggccttggaggcagtgaggaaagcggggaggaggaactggatgaataccggtcagagcggatcctggacggggtttccaccgctgacccgattcgggaatatctgaaggaaattggatccatttcccttctgaccccggaagaagagacggacctggcaaggcgcaagtccgagggggacgcagaggcgggacggcagctggtagaggccaacctgcgtctggtggtgagcattgcaaagcggtatacgggacgtggaatgggctttttagatctggtccaggagggcaacctgggacttatgaaggcagtggagaagtttgattattccaagggataccgtctcagcacctacgcaacctggtgggtgaaacagtccattaccaggtccctggcagaccagtccaggaccatacggcttccggtccatatggttgaggcggtgaataaaatccggagggcccagcgcagtctctccgtaaggctgggacgggaaccatccacggaggaaatcgcagaagaagtaggaatgccggaaaagcgggttacggagctgatacaggcatccggggacacggtatccctggagactccggtgggagatgaggagggctccaacctgggggattttgtggcggatgatgccaatgcctccacggaagacaaggcggagagcttcctgcttcgggaagagattgacgccatgctgcaggggcttaatccaagggaacgggaggtcatcatcctgcggttcggactggagacaggccatccccttacgctggaggaggtgggcaggcgctttaacgtgaccagggagagaatccgccagatagagacagcggccttaaggaagctgcgcaacccgtccaagagcaggaaaatcagggatttcctgccgggatgacaggggaaaaggctaatgtgatatacatttccacagagttattagcactcaataaaaatgagtgctaattttttattgacattttcccctgcaggtactaaaatgtagtttgtgagtaaacatgtaaatttaagaagaaacacaatgatagaaagaaagaggcggatacgagatggcaaagaaaggcagtttatcaattacaagcgagaacattttcccggtaatcaagaaatggctgtattctgaccatgatattttttacagggaacttatcagcaatggttctgatgcgattaccaagcttaagaagctggagctgatgggggaatatgagagacccgaggatgtggagtacaagatccaggtaagtgttaacccgacggacaagaccattaagattacggataacggtctgggcatgactgaggatgagattgacaagtatattaaccagattgcgttttccggtgtccaggacttcatggagaagtataaggacaaggcaaatgaggaccagattatcggccattttggtctgggcttctattccgcgttcatggtttcagacaaggtgtccattgactccctttcctacgcaaaggatgcaaagcccgtgcactgggaatcagagggcggcattgagttcgagatgggcgaaggggacaaggctgaggtgggtaccaccatcaccctttacctcaatgaggacagcaccgagttctgtaatgaatacagggcaagggaagtgattgaaaagtactgtgcgttcatgccggtgaatatcttcctggacaatgagacagcagaacctcagtatgagaccattgagaaggatgagcttaaggacaaggatacggttgtggagaccgtgattgagccggcaaagaccgaggagaaggagaatgaggacggcaccaaggaaaccgttgagatagagccttccagggaaaaatataagatcttaaagcgcccggtggcgttaaatgatacaaatccgctgtggaacaagcatcccaatgagtgcagcgaggacgattataaggatttctaccgcaaggtattcagggattacaaggaaccgctgttctggatccacctgaacatggattatccgttcaacttaaagggaatcctgtatttccccaagattaacatggaatatgacagcctggagggaaccatcaagctttacaacagccaggtattcattgcggacaatatcaaggaagtgattcctgagttcctgatgctgttaaagggcgtcatcgactgtccggacctgccccttaacgtatccagaagcgcgctgcagaacgatggttttgtaaagaagatttctgattatattaccaagaaggtggctgacaagctttccggcatgtgcaagacggaccgtgagaactatgagaagtactgggatgatatcgcgccattcatcaagttcggttatatcaaggatgaaaagttctctgagaaaatgggggattatatcctttataagaatctggagggcaaatacctcacccttcaggactgcctggatgagaacaaggaaaagcatgagaatacggtgttctatgtgaccaatgaaaaggaacagagccagtatatcaacatgttcagggaggaaggcattgacgctgtcatcatgcctgctgccattgacaatcctttcatcagccatgtggagcagaagaaggaagggcttaagttcctgcgcattgatacggacctgaacgctgcgttcaaggaagaggtcaaggaggacgacgaagagttcaagaagacttccgatgaactgacggaactgtttaagaaagcccttggcaatgacaagctggacatcaaggtagagaagatgaagaacgcaggcgtggcttccatgattaccgtgtccgaggaaacccgccgtatgcaggatatgatgaagatgtacagcatgggaggcatggacatgggcatgttcggcggcacgggagagacactggtgctcaacgccaaccatcccctggtacagtatgtgctgaacaacaaggaaggcgaaaacacaggtaagatctgcgagcagctttatgacctggcaagtctgggccacggaccgctggcgccggagcgtatgactaaattcgtgaaccgcagcaatgaaatcatgctgatcatggctggggagaagaaagaatcatgattatgggatctcggctgaaccggtaatcttggcaaacgtaatatagatgacataacaggaatgcctgtaggtccggaccgctgtccggaacctcaggcattcctgttttatggtgaggaggatctggcctgcatcatatatcctttagcctatggttcagggctgcccggtccatgccaaggatccgcgcggcctcatccatatcctgggtatgacgcaggacctccgtgatatacgttttttcaaactcggcaaccgcctgttttaaggacttgaactccggttcctgggatatccggggggccgggctgtgggaaaaacggtagttctctttcagaaggggacctgttatctcggacgcatcctccagtacgtaaagcttttccatgaaattctgtatctcccggatattgcccagccactcctgatccatcaggaagtccatggcttccggtgaaaatgttttctggcagccataaatctgtccgaaccgcagggagaggtattctatcagggcgcgtatgtcctgcctgcgtctggataagggagggatatcaaaggacaccacattgaggcggtaatataaatccagccggaagtccccggcctttatcatcttgggaaggctgcggttggtggcggcaatgatgcggatgttgacggatgtgtcctcagtggaaccgatgctcctcatgctgtgctcctggaccacctgaagaagttttgtctgtaaatccaggtccagctcgccgatttcatccaggaacaaggttcctcctgctgcctgggcaaccagcccctggcggccggaaccgctgcttccggtaaacgcgcctgactcgtagccgaagaactcggattcaaacagttcagacgggatggcgctgcagttaatgtggatgaagggcgccccggccctggggctgtggcggtggatgaattttgcaaggcagtccttcccggtgccggaagcgcctgtaatcagtatgttggcgtcagtgggggcgatgctcagcgcatcggaatacagctttaccatgctgctgtccctggccacaatcccctcatttaaaagattgtcactaaaatgttccatatcggtatcttacctcggctgttgcccccctgggatgtgcagatggcggaaatgaattttcaaacacgtcctggcgccatcgtgtcagtgcagggcatttccatgttttatgtgtgttttaaatgccgtatttcttgcgctttttggaaagtgtggaaatatccacccccatggcttccgctgccgcggtggtggtcttgtggcgtttcagggcttcacagatcagacgtttttccaaaaggacggtggcatccttcaggttcaggtccggggaatccaggtctgaaatcattccaaggatgctttcccctcccggtaccgtaagggaggatggaagctctgcaggggtaatcacgtcattggtgccgattaccaccaggctttcgattatgtgcatcagttcacggatattgcccggccagtcatggcgcataaggacatccatggcggaagcgcccatggttttgtgggtggagtattttttgttgaagcggttcaggaatgcatttactaaaagggggatttccactgtccgctcacgcagcggcggaatctccactgtcacaacgttcagcctgtaatataaatccagacggaattgtccgtccttaaccatctgttccagattgcggttggtggcggcgatgatgcggatatctaaaggcacggtcctggccgacccgatacgccgtacgctccgctcctggaccacctgtaagagctttgcctgtatgtcgaggccaagctcaccgatttcatctaagaacagggtgccgccgtcggccagttcaataaggccggtcttaccggtcttggatgcacctgtaaatgctccggcctcgtatccgaacagctcgctttcaaacaggctttttggaatggccccaaggttaacatggatgaaattcctgtttttacggttgctgatggagtggatgaatttggcatacacatccttgcccaccccggactcgcccaggatcatcaccgaggtggtgactgaggcaagcctggtggctattttataaatctgcttcatccgtatatctgagacaatgatgtccttggataaaagggaggaggtcagcagctcattcaactgggattccagggccaggttcctggcatttaactggtttagctctgactgcatgcggatggattcgctgcagttggtgacagagtaaatcaggtacctgataacaccgccgctgtcccgcacaggggtcagggtcgtggcaatgaagtcctcattgggataggttacgatgtcggtaagctcctcgcctgtttccagcacctggtccgccattacgggaccggacaaagtgaccaggttcctgcgggatatgatccgtatatcctggccgataaaatcttttacgttaaagcccgccatggcgctgtagtaatcattgccccataatatcataccctttgcgtccgcaatgatgattcccagcttgcaatggtctaaaaggcagtacaatgtctgaatatcaagttcttttgtttcactgttctccacggtcaatctccattctcttatcatcactgatggtaacccgattaagcaatgccctgttcagcggccagctcctgttattaagaatagaacatcattaattttttgtcaaacactgtttggatgattattcctgacaacgataaaaacaagaatgatatttgtgcaatatgtcggtgcctgatcttgaaaaaaatcataatccatgttaaaaacatagcaggaattttgaaaaaaatcaacatcttaattgatttattttttccgacaatagttttaattcaagcaaaaaaataaataatatttttttttgttttttattatcactgtatttacaaggtattttctacatttcttttgtctgttccctctttttatcagtgcaaaaaagccgatatccaaaaaaacaggaaagaaaattgctatatatcagggcagagggtaaaaaaataacaccagagtcatttcaaccatggattgttaatttttttacaaatcaaagacttattttaaggaggggcttatgaacaaatattttttaactgaggaccagctgatgattcaggaactggcaaaaaagtttgccgacgaggtagtggcggcaacggtaacggaactggacgagaagcatgaattcccaatggcagaggtgaaacagtgcgcggagatgggatttttaggggtctgtgtgccggaagagtacggcggcgcaggactggaccatttaagtgacgtcctggtcatggaacagcttgcgcgccattcctcttccctggcctccatcatcgatgcccatgcatcccttggaagcatgcctatcctcatggcgggttctgaagagcagaaacagaaatatctggctccggcagcaactggggagacactgtgcgcctttgcactgaccgaaccgcagtcaggttctgatgcggcccagatccgtacgaccgctgtcctggacggggatgagtgggtaatcaacggctccaaggcattcatcaccaacagtacatatgcatccacattcctggtggctgcaaaaacagatctggaggcaaagggcagccgcggtatttccattttcattgttcctgcaggccttccgggatttgaggtgggcaagcctgaggagaagatgagtaaccgcagttcctattcctgcccattgtcctttaccgatgtgcgcatcccgaaggagaacctggtaggtgagctgaaccgcgggttcccaatcttcatgaagtgtgtggatgacggccgtgtggcaatctccgcagtggcagtgggcatggcacagggagtcctggagcgtgcggccaaatattccaaggagcgtgtgacctttggccatcccatctgtgagaaccaggccattgcgttcaagctggccgagatggcaactgagattgaggtggcaagggccatgctgtacaatacggcacgcatgagcgacaacggggttcccttcagcaaggaagcaaccatgtgtaagatgttctgctccgagatgtgcgtgagggtatgtgatatgggccttcagatcatgggcggctatggcctgtgcaatgagtatgaggtggagcgtttctaccgggatgcaaagcttctgaccattggggaagggacgtctgaaatctgccgcatggtggtcggaaggcatgtgctgaaggaatactaaaaatcaataaccggacaggatccgggatacaggaggggttttagatgaaacgttcatttttgtacctgagtgagttccatgtgggtgatacgttcaccacgctgtcaagaaccgtcacggagacggatgtggtgctgtttgcagggataacgggggataacaacccaatccacacggacaggacttatgcggaaagcctgccgtttaagagcaggattgcccatggccttctgggcgcaggcattgccaccggcctgtggggccgcatgggcctggtggacggttccgccattgcggcgctgagcacggagtggaagttcgtaggcgccatcaagataggggataccatccactgtgaggtggaggtgctggaagccaagcaatctaaatccaagccggacaggggcgtgctgaatatccagtataccatcctgaaccaggacaatcaggtctgccaggtgggaagcatggcaaccatgctgtactgggcgccgccaaaagaaaaggaatgaggaggaattacatatggaaatcagaagatatgatgataaaatcgcggttgtaacaggcgctgccaatggaatcggacttagcatggtaaagcggctggtggaagagggggccagggtggctgccctggatattgataccgaaacaatggaaaaggaatatgcgggccaggaggaagacatttttaaggtttactgtgacgtatcggaaaaaaagagcgtggacgaggccatcgcaaaggtgttagggcactatggaaggattgacgtgctgtttagcaatgcgggaatcatcgggcgccagagccttctggatacaaccgaggagacatggcgcaaggtgattgatatcaacttaaacggcatgttcttcgtgaaccaggcagtgctgcgctccatggtggaaaaaggaataaaaggagcagtggtcaataccagctccattgcctccgcaaccgtttccaccaacacaggcgcctacagcgccagcaagggaggtgttacccagtttaccaaatgggctgcccttgagatggcgcctcacggaatccgcgtcaatgcaatcgggccgggaaccagcgttaccaggataaccgagggcacgcgttttaacccggagaggaatgagaaattcctgcgcaacatacctatgggccggtatggggagcctgaggaggcagcggcggcagccctgtatctgggcagcgaggatgccagctacatcactggcgtcacattgctggaggacggcgggttctcactattctagggaaaggttgagatatggatatgagttggaaagaaaaatatgcagataagatttatacagcggcagaagcggtctcccatgttaaatcaggggaaaagatcatctttggggactgggtcagcgagccgcccgcattggtggaggcgctggtaaaccgggcggatgaacttaagggagtggaaatcatacacggaatgagcccgggacccaatgcttatgtggctccggaatacgagggtattttccatcacacgtccctgttcatcggacctaagaccaggaaggcctatgcggagaaacggattgattacatcggcggaaccaccttcagccgctggccggacctgttcgcaaagaacccggacttaaatccacactgggcgttcatccaggtttcagaaccggatgaggaggggatgtgcagttttggcaatgcgtgctgcttctcagaacctgccgccaggacagcggaccgcatcattgcgcagattaatcccaagatgcctacgctggggggcaagaagatttccctggataagattgattatattgtaccggctgaatccggtctttataccataggacgggcggagatagatgccaagacccagaccattgccgattatgtggcggaactggtggaggacggggctaccatccagctaggaatcggggcattgccggatgccattgcaaggaacctgatgggcaagaaggatttgggcgtacactctgagacgctgaccgaagccatgatggaactggtgcaggccggggtcatcaacaacagtaagaagaccctgaacccgggcatatgcataggcgcccaggcagccggttccgagaagttctatgagttcattgaccaccatccgctgtttgccgtatatccggtggattacgtcaacgacccatatgtggtggggcagaactataagcagacctccatcaactcctgcatggaggtggacctgaaaggacaggtgaattccgagaccgtgggcggacgccagtacagcggcatcggcggacagctggaccacgtgcggggcgcccagctgtcagagggcggcaagtccatcctggcccttaactccacggccaggcaggacactatttccaaaatcgtgccatattttgcgccggggaacgtaaccaccatatccaggtatgatgtccactacatcgtgacggaatatggcgttgcggaccttaagtacaaaacagagggccagagggcccttgcccttatatccatcgcccatcccaagttccgcgacgagcttaagtttaaggcagcggaaatgggaattctgtaattaggagatgtgcaatgaccataacaaaacaaaagaacaggcgtatcatcctgagcgcgctgtttgtcaatgcattctgctgcggaggcgtgtatgcgtggagcgtgttctccggttccctggcagagtaccgtaactgggactacggccaggtgacgctggcatattcgctgatgtcgctgatgctctcgtttttcgggattgcgggcggcaagatactggaccggttcgggcctaaaaagctgatgcttgcggccagcgtcatgtggggcggagggtggttcctgacaggatgcgtgggacagctctggcagctctatctggtgtttggcatcatgacggcagtggggtccggcctggcgtacaatcccagcatcaccacagcggtccggtggtatccggacaaaaagggctttgcctcagggcttataacgggagccacgggcctgtcctcgctggtggttgccccggtggcgaatatgctgttggagcggtataatgtatccgtggcattccggatcgtgggggctgcgttcctgctcctcatgttctgcgcaagccttttgacggatacacctgaacctggatgggcgccagaaggctgtgacgccgggggaaagacatcgggcgccagcacggtaaaggatttcacatggaaggaaatgtttggggacaggcgtttttacctgatatggctggcatttttagggggctgtgtgtccggccttatgctgattgggcacgcatccaccatcggaaaagaggttgccggcataagcagcggcgaagcagcgctcctggtgggaatcatggcagtggccaatttcctgggccgtatgctgatgggcgccctgtccgataaaatcggccgctaccagacaatcctcatatccctggcagccagtaccgtgggaatggtcgtgttgtcccaggcaaagggattcgggatattcgtaacagcgcttatcctgctgtgcgtctgctttggcggcgtgctgagcgtgttccccaatatcgtgtctgagaacttcgggcttaagaacatgggaatcaattacggaatcgtgttcactgcctatggaatcgcagccctgattggtcccatgacggcatccgcggtcaagaattccagcggttcctataacatggcattcatcatagcggggatatttgcggcggcggcatttgtgctggtattcgtaatctatcgtatggctaagaaaaatactttgaaataacagagggagaaaaaatatgggtgtactgttagcgtttactcttcttgtaatattgatgtataaaaaggtcccgatcatcgttgctgccccggtgtgcgcagtggtaatggccgccctttcagggcttaatatcatgtccgccctgacaggcgactacatggaagcaatggtcggcttcattaaatcttatttcatactgttccttatctgtgctatatttgggcgcatcatggatgtgtcgggcgctgcttactccatcggaaagtggctgggcgcaaaattaggcgccagatatgcaatgtggggcgtaagtgttgcagccctggtgcttacctatggcggcgtgtcctgttttgtcctggtttttgcgatttatccaattgcccttgtattgtttaaagaagctgatatcagccgtaagctgattcccggaaccatcatagcaggcatgtccactgcacccaatattttatgggggtctcctggactttgcaatgtcattccgactacatatctgggcacgaccgttaaggcagccccgttggtcagcgtaatctgctccatattcttctatctcagcgcaatggcttatctgatattcgaaaaccgtaagatgcagaagaggggcgagagattcattccaactgaaaaaatagaaaagctccttgcggataacgcagcgaagaaagcaatcaatccaggccttgcgctggttcctattgctgtcatcatcattacattaaacggatttaacctggatgttaacatcgcgatgctgtgcggggtcattgccggatatatcctgttctggggaaatatcacagacaagatggataccatggtagtgggggcgcagaatgcaatcggttccattatgaatacgtccactgcagtgggtatcggcggcgttgctaagattactgctgcatttggttcactgatgcagtgggtatccagccttggcggttctcctcttgtttcctgggccgcggcagttaccatgattgccggcgcttgtggttccggttccggcggagttgccctggcctgttccacattggcagataaatatctggcaatgggcgtgaatcctgaaatccttcaccgtattgccagctgtgcatgtattgtcctggattcccttccatggaacggcgtcatgattaccgtcatgcaggcatgtgacctgacccataaggaagcttataagcatctgttcatgataacggttgtacttgcattcttcaatctgctgctttgcgtgggcctgggcctgattatgtattaaaatacctttcaaaaaggaagatgacatgaaatctttagaggaacgccggaaggacctgctggcccgttttcctgtatggaagaaaatgacgctttaccaaggtctggcgtcaaaggcggccgaaggcccggagcgtgtgtttttgctggtagagggaagggaatttacctacggggaagtccttggggaagcggaccgcataagcgcggccttatggtccatgggacttacaaagggcggctgtgtggccgttgccctgagtaaccggattgaatttgtcacggtcacatttgccctggcgaaagccggggcagtgaaggtgcctgtgaaccgcaatgcaagcctgagggaactggagtatatcctggaacagaccggggccaggttcctgattacggaaagacctgtggaggctgaagataagtctgcctgtcccggactgtgccatatcatctgcctggatggcaccgcaggggcggacgggcggtacctttcatgggaggaatttctggaaaaggggaaggccccggccatggagatgccctggccggatgcggacagcatttccgacatcatttatacttcgggaagcacagggcggccgaaaggagtgatgctttcacatgacatgctgtggcgcagcgcatttgccagctgcgtgaacaggggatatgagacggggcgcaggatatatgtaccccttcccctgttccatgtatacggttatgtggaagggctgctggcggcaatcctggtaggcgggagcatcctgatcaccagaggcaaatttgacgtgaaaaaggcactggatgccatggagcgctgcggagccaatgatatcttaagcgtgccgtccatcatgatgaaactgctccaatatcctgagctgggacaatacccgctgaaggaactccacgcagtctactgttccgcctccatctgtccaagatgggtgtggaaggcgatacgggaaagactcagggtacaggaagtgatcacgggatacgggatgaccgaggtgtgcggggcatccatgcagacagatcctgaggatgatgatgaggtcctggccggacgtgttgggaaaatcctctatggaggcccggcaggggatgagcgcctgaatggaaatataatcgagtacaaggtgattgacgaaaacggtgaggaactgcctttaggaggctgcggccagctgctgtgcaggggaccgatcgtgaccaggggatattaccgggacggggaggcaaccgccctggccgtggatcaggaaggatggctgaaaacaggggacgtggggtattttgatgaaaaagggtacctcaagttcctgggccgctgcaatgatatgtataagattaacggggaaaatgtctcgccccagtacctggataaaatcatatccaagtgtgaacacgtggtaacggtggagacggtaggcgtgccggatgagaagctggggtatatcggcgctgcgttcgtggatgcggacaacccggaccaggagacaaaggaatccattgtggattactgtaaagccaacctggcgccataccaggtgcccagatattttttctttacggacagctgtacctggcctcacacaactactggcaaggtacagaaattcaagctccgggagattgcaaggaaacggatggaggaagaggatggccaggtttgaacatgtggcgggcaacacgggctgcctgagtcttaagggaaactgtatccctgtgtactgcatgaccgaaaaggaatggatcatcatggattccggctcacgctttgaccgggatgagttaatccattatctgaaggaacatacaatcaatataaaagcagtgctcaccagccatgcccattatgaccatgtggggaaccatgccgtgcttcaggaaatgttcggatgtgaatgtgtcatgacggcctttgacgcaggggcgctccatgacacggtggccttaaagtcctgtttttattcctgcacggaaacggaaatcaggaagaatttttctgatatggtgtgcagggctgacaggctgatagaagacggggcaaaggaaatcctggtgtccggcgtccggtttaaggtaattggactgccgggccatgcggccagccaggtggggttcgtgacgccggatcaggtggcgtatctgggcgactgcctgctgggaccttctgaggcccggcaggaaaaggtaatctatatgctcaactggaagacagcacttgataccatgaggatggcggcagggcgttttgacggctctccctgcatcctgtcccattatggggtatacagggacatgaagcctgtgctggaagccaatatccaggcatttgaggagatggaggggcgcatccgggaaatcatgccggaggagttttatctggaggacatggtgaaagggctgacagggcatatgggcatagtggtaaagagcctgcccaaggcccgtctcatggagcgggtggtgcgttccatcctggaatatatggctgagacaggcggactggatatagggataaaggacggtgtgattgtatatacccgcggcggtcaatcccatgtgtccggcaatacccggacacactgacaacaatgaaaataagaggtggatgatatatgaatatattagtttgtatcaaacaggtaccggatacaaccgaaattaaaatcgatccggtaaccaatacattgatccgtgcaggcgttccaagcatcgtcaatccctttgacgcatatgctctggagattgccgcccggattaaggatgtgacaccaggaacaaagataacgcttttgtccatgggaccggagcaggccaaggcggctttaaaggagtgcctggccgtgggcggtgacaaggcgtacctggtcagcgacagggcctttggcggagccgataccctggctaccagctatacccttaagacagccattgaaaagctggaggagacggaaggtaaattcgatatcattttctgcggcaaacaggccattgacggcgatacggcccaggtcggacctgagattgcggagcatcttgattatcctcaggtcacctacgcggtggaagccagggtggaaggcggggaggtcctggtaaaacgcgagacaggggacggctttgaggtgctggcagccagcatgccgtgtgttgtcacggtcacaaagccctactttgacccaaggttccctaccatcaagtccaagctggcagcagggcgtgcgcagataccgaccctgacagcggacgacctgcctgtggacagggaaagcatcggtttaaaaggttcccctaccaaggttaagaaaagctttactcctccccagaagcagggtgggatcaagatttctgaggacagcagcgaggcatcggccaggaagttattcgccatgttaagcgatgcaaatatcattggatagagggagggactgacatggaggctaagaataaggatttatgggtatttatagaaacggatgaggaaggaaaggccaggaacgtgggcctggagcttctgaatccgggaaggcgcctggctgataagcagggcggggaactgataggcgtggtaatcggatgcggcatcggggaggctgtgaaggcagccgttgcatacggggctgacaaggtaatcgccgtggacggcgaagaatataaacattacaccaccgacgcttacacggacgcggtctgcgccctggttgaaaaatacgggcctaccaccatgctgattggcgcaaccaatgagggccgggacatggggccgcgtatttcctgccgtctgaggacaggactgacagcggactgtacgggccttgatattgatgaggagagcggcaacatggcatggacacgtcctgcctttggaggaaacctgatggcaaccatcctctgccccaaccaccgcccacagattggcacggtccgtccgggcgtgttcaaaaagggtgaaagggatgatgcaaggcaggcagaggtcatccatgaggatatccacatcacggctgacaggatacgcacccgcctggtggaggtcatccatgagatgggggcggagaacgtggatctggagggcgctgaaatcatcgtgtccggcggccgcggggtcggagggcctgaaggctttgcgcccttaaaggaactggctgacctggtaggcggtgttgtgggggcgtcccgcgccgcagtggattccggctggattgcccatgcccatcaggtgggacagaccggcaagaccgttggacccaaggtgtatattgcctgcggcatatccggggccatacagcacgtggcgggaatgagcggttccggcaccatcatagcaatcaacaaggatccggaagccccaatctttcatattgctgattacagcgtggtaggggatttaaagctggtaatccccgtactgatccaggaaatcaagaagagccgcgcttagacgaaaggaagtcattttcctatgtatgaatgtttatttgaagaaaaccacattggcaccatgaagctgaagaaccgcctgatcgtgccggccatgtccacccgttttgtgggggaggacggcagggccacggagcagttcattgcctaccatgaaaccagggcaaagggcggctgggcactgatcatcacggaagatttcctgattgacgagggagtgggcgttaagaaggaactgccgggactttgggatgacgggcagattgaaggttataagaagtgcacggaccggatccacgctgcaggcgggaaaatctgcgcccagatttaccatgcgggaaggaatacacacagcggcatcacaggcatccataacgtgggtccctcccccatctgcgacccttccaaccgggaggtgccccatgaactgacggttggggaaataaaggccattgaggaaaaattcgcggatgcggcgctgcgggccaggaaggccggatttgacgcagtggagcttcacggcgcccatggatacctgattgcccagttcctgtccccgttctccaaccggagggcggatgagtacggaggcacgctggagaaccgtgccaggtttgcagtggagacagtgaaggcggtgaaggaaagggcgggatgggattatcctgtgctgctgcggatttcagccacggagttcattgaccagggcatgaatgtggagcaggcaaaggccatctgccggctggtggaacaggccggggcggatgccatcaactgttcccagtcagggccggccacattttacaatacggttcccagcttctatgtgccaagcggcgcgtttgtggaactggcagatgagataaggaaggttgtgggcatcccggttgctacggtggggaggattaacagcccgcagctggcggaggaggtaatcctgtccggcaaggcagacctggtggccatggggcgggcttccgtggcagacccgtacctgcccgctaagctccaatcaggggatacgcagtccatactcacctgcatcggatgctgccagggatgccttgggagcacgttaaggaaaaagacacttacctgccttgtgaatccatttgcaggcaaggaaaccacatattcgccggaggacagggcaggacatattaagaagatagtggttgccggaggcggcatcagcggctgtgaggcagccattgtggcggccatgcggggccatcaggtaattctggcggagcgggaagcacggctgggaggccagtggattgcggccggcatcccatgcagcaaggcggattttccttcctttgtgagctggcagaagcatatgcttttacgcctgggagtgaccgtgcttctgaaccaggaagcggaccgggagttccttcttaagatggcgccggatctggtgcttgacgcaacgggaagcacgcctgtgatggtgcctgttcccggaatcgaaaccgcggggactgcatttgcccaggaagtccttacagggaagaaaccgttcggcaatcatccgctgatcataggcggagggcttgcgggtgcggaaaccgcggagttcattgcaggctatcaggttccggtggagctggtggagatgcgggaggccattgccattgactgcgagcctggcccgaagtatttccttctgaaggcattgagggagctgggcgtgtccatgtacaccatgacaaccgtgaaaagggtggaaggaacaaccgttgtcctggaaaaggatggcagggaaatgcgtgtggaaggcattgaccagatcatcctggcagtggggatgcgtccatcacagggacttagggaaatgctggctgacacggggctggaggtaaggcccatcggggatgcggcctcggtgaaaaacgggttttccaatgtgcaggaggcatttgcggcagcctgtgatatctgaacctgccggatgacagtgtcccattgaggcccggtgtgcggcatgggtttcgttgtgcggcatgggttccggtgtgcggcgtgggttccggtgtgcggcgtgggttccggtgtgcggcatgggttccggtgtgcagcataggttccggtgtacggcatggttccggtgtacggcatgggttccggtgtatggcatgaattcctgtggatatggcttccgttaataagaggaggggattgcgtggaaaatggtctggtcatgagccaggaactgaaacagaagcagacgctgtccgcgtaccagtaccagtcccttcatatccttcatctgggcaatgcccaggtaggcgaactgctgaaaaaagaatatctggagaatcccttcattgaacagagggaggggttctcgggagaagagtatcagtggctggaatattataaggccaatgtaaaggaaagcaggccaattccagggaatggcagcggaccggaagccggggatgcggacggggacaatggaaaggagtatggtacatccgggtgcgactggaggatggatatcaaggaacagctttatgacggccgcacaccggagaaccggcggcgcctgttggaacagatgatccttcttctggatgaccatggcttcctggccttttctgagcgggaaggaagcaggctgttaaagataccggtcaggcagtaccgcgttctcaggaaacagctgatggagctggagcctgagggaatcggatgcgtttccatgggagagtatttcctgttccagcttatgaaaaaaggaatccatgtgccggacgccttccgggatctctgcatgaaccatctggaagatataacagagatgacctttgtccagattgcgcatatgatccacgcctcctttcaggaggtcaagcggtgggtgcgggtcctgggtacgcttaagccgtatccaatccgggattccggggaaggctgcgctgtggaaaccgtgattcccgacattttaatcgtacccaggggcggtggactggaggtcagggttaatgattattacatgcgccagtactgtgtcagcgatttttaccgcaggaccatgaaggatgaggataatgaagaactgcaggaatatatggacaggaagctattgagggccaggcagatatatctggcagtgagcaggcgcaaccggaccatctgcaggatgggggaatacctgctgaaggtccagggcagctttttcagaggcggattccttaccgggatgacatataagatgtttgcggatgaactggaagtccatgaatccacggtatgccgcattgtctccaacaaatatgtgtcatgtccccagggcatcctgccccttaagtatttcttcagcaagggcgtggacgtggtggatggtcagggccgcgtcacaggcaccatggggaaatccagtgtcagggaactgattgcattcctcattgaaaaggaaccgggagacaggccctacagtgacgggaagctggctgatatgctgaaaaaggaatatggcctgaggatttccaggaggaccgtttccaattaccgggaggaagccgggatacggagcgtgtatgagcggaaggtgtagggaaggatagaagggcgggaaaaactggtttatggttttcctgctttttgcgtgggctgattttgggtggagcatatgccatataagatatccttgacattatattaaccgcatgagaaaatgatgaaatgtgaaaaaggataggaggaccccggattatcacagacatccatgagaaccgggcagtgggagaggatatgattatgaacgtaaatgtttatgttgcaagtgcattcagtaaagatgatatgggcggaaaccgcgcaggcgtggtgcttgcggggccggatctgaatgaggcggaaaaaaccgggatagcatatcagttagggtatccggagacagcctttgtgtcggagtcagggcgtgctgacctgaaactggaatattttacacccacaggggaagtccccttgtgcggtcatgcaaccgtgggcacgtttgttgtgctgaggcatttacatatgttagataaaccgtgttacaccatcgagacgaaatcaggtatcctgcgggtcactgccggtgaggacggcctgatcctcatggaacagaatgccccgcgtttttatgaaacgctggataaggttgatttacaaaggtgcttctgtccggacatcattgcggatgacatgcctgtccagattgtctctaccggattaaaggatatactggtccccataagcagtccggcggctttaggggatatgatccctgattttgcggaggtttccaggctgagccgggaaaaggactgcgtgggtgtccatgccttttcgcttatgaaggaggcgggagagttgaccgcggtatgcaggaattttgcccctctctatggaatcaatgaggaatccgcaaccggcacctccaactgtgccctggcctgctacctgtaccaatacggtttgaggcagtcccggtatgtgtttgagcaaggacataatttaaacagcatttccaggatatacgtccatgtggaaggtgacagccatgctgtctcaggagtccgtgtgggcggatacggatatgtggatggcaggaagaatgttgaggtttagggacaacggcggaatccctatataataggaagccaatattcaatcaggcttttcccatccgcgtccatatcctcgccatatcgtgcgaaatcatatggcgcatgcccattcagacggcaggtggactgtggaaaccatgtcttgtagatataatctgccaccggctgtaagctgtccgtgctcctggccctgaaacggaagatgacatattttccggcaggaagttcctttgcctccattcccgggggaagcctgccgggctgagtctgttctgatgcggcatagtagtcaaaggcaggctgtctgtccgcatccgcatcccatttcgtgtaatcattaaggccaaccaggaaatcaggatccttccggttggggattgtgtgctttgcggcgtggagcctgcgccagcactgtcctatgacaaagaagccaaggcgtgtgtttttcttatatccagccaggtatatggggccgctttccattgtgtgtatatccattatcctgtctcccctcagtgcatctgtcccgtctgcggtaaacttaagctgcaggggatggaagtccccctttttcctgaatgccctgggactggttctgaacagcgccctgaaccccactgtaaaagcttgctggctgccataccctgcggacagggcaatgtccatgacaggccggtccgtgaacaccagctgccttgcagcctcggtcagccgccgcctctggatataggtgtgcagggaaagcccggtaatggatgtgaacatccggctaagatggtatctggaatacccggcttgccgggaaatgctttctgagtccagcctgtcctccagatggctgtcaatgtaatcaaccacttcctggataatctgtatattcgttttcatacttcatcctcctgtatgattcgatgatattattataatacatccggaatggttatgtttcacattttgtgctgggtctgtcatatccttaccctttcaaccttatcaggctcattcgatacgatataataaaaaatagttatttttttagccggttacgtcttttctataagctgaaaaccgcatggttactgggtttcttgtaaaatgggcatatgtgtaaagcgacaaaatagttcacaatcggtgcccggatatacaaaaagagttatggacagtaacatgaagttatgatacaaaatgaactgtttgacatttccgcacgctgatattagaatggaaatggttaagttgtgtagcatttgagagggaaagcgaatggattatttaatgattacatctccctgttttgaacacggggggatgattccaaaagagtataccggatatggagcggacggatcacccgaattggtgttgactggtttaagcaaagatgctgtatctatcgcaattattatgaatgatatggaccatccaataccagcctataatcattgggtcatctggaatattcccgccatatctgtaatcccagggaatatccatcatggggaacaagtgagctctttaggtggtgccgtgcaaggacttggctatggaaaacaccggtatcgaggaccaaagccgccatttcagtggtcacatatgtatcacttcaatgtgtttgtgctggactgttttcttgatttgcccagtacctccaggaaaaaggatttaatggaagctatgcaagggcacattttgcagcaagctgttttagcagggcactatagatgatgtgcgccttattgggtaagagtgccttcgtcggataaggcgaacgacagaattttgtaataaacggaggttttgcattgaaaaaaacaacgaagtcttttatcttttggtgtctaatcatatctgttttcgagatttttatgcaccaaatcggacaagattcaaaaagcattgtactcattagatttaacccattactgaatataatcgctgactcccaaggcccattatatagtttaatggactctggtttgcaagtgccatgtaatacgattactggccaaatatctatctattggtatattggcttagttttaacttttttgctttatggtattgtcttagatggaataaaaatgctatttcgcaaaattacccacaaagacaaatagattgacgtagtacgccttattggtataaggcaccccaatcccccgataagggccgctttcgctgccttgctaaacgctccgcctgtggagcggctactcgcccttgcgggcgctgaaagacgttaaaccttaccgcctgggaaaaaggtgtgtctctcatatttgaaagcgtccggaggatgcgtagccgccccgtaagggcggtgaaaagggccgtcgctggcggttcttttctggttttggggtccggtccccaacaagcgttttgcaggagtgcatatactcctgccctgcttgccacgattgttttgtatgggattggtacatcggccacgcatggaaatagcccaggcatgtgacggcgccaatctcacgtcagggagatcatgcggaacgatagaagcatgttttcggggattcaggattaatcatacaggcccctcggttaggcacccgcaaaggccgtcctgcctcttgcggtttcgggataagtatggtatactatgcacatcagcaggtcggacaagggcgtgctgattttatatttcgtggtgcccaactttacaaaaccatgtaatgcccatttcatgtgggtttgcggggcctgaccatggaacaatctgtcatcttatggcgactgaaatagctatacaggcaatgaaaaatatcaatggaaccacaaaaaacaatctggaaaataagacggatatacagcgaaagggggaacggccatgattacggtttttaacaggaaagaacttcttgtcacctattccatggagcttcagtccaaggccaggagcgcccttgaagggtgcgggattgactatattgtggacacgggcggcactgccgcgcgcaatataggttcagggccgattggggtggaccggttgggaagcaatccctcctgctcatgtgaatataagatatatgtgaacagaaaggattatgaaaaggcccaggcggcattggccggtaaactgaaatagggtggatactatctacagatacgttccaggaaacggcgcttgtatttcatttccgcgtaatccgtgattttcttcatatacaccgcgtcatacattccgccaatcacccctgcaaccgggattccctggagaaacttcatatataagagttcatgggagagtgcttctgctgtcagacgtatctcttcctttttatccagtccggcaaaggcctggtcaggggaaagggatacggatcctgtaatcatccggttcagtccttcatcagccatgatccgttcttcccctgataaaaggggggtgcggattaaccgtaggataaaacactgctcgccggccgtatcataggtgaagccatagctgagggcaagttcgtagattgccttcaggatcattcccgtgaacaggggaatatcgggcagcccgataccaaggacgccaagccccataccgctggcgccggatgccaggaggttgacggccttgctgtttttggcattttttgaaaatgccttcaggtttttcctgctttctttcaggcccacggcgtaagcgttgaccttgtaagccatctcgcgattttctttgtggtatgttttctctatgacgccggttcccttttcaaacaccagttcaaatgccttacagaatgccaggtcaagggtagaggacagtctgtcaggcacaaaccgttccagctgacggtttaggacaggctgtctttcttttcctgcgttcaggaggaagcggtcctcctgcttcttaagcgcggcccactctgcttcacgggccggtttccttctaaatctcatgctatcacctctgcttttcaggttaaatccaaatcattcctgctgtctgatatgataccacaaaaacccgtgaatgggaaacagatgggaaactgttaaaactattatggacattatgcttgacagacacatgagaagccgttataatggttgattgttgcaactgttgtataatgcaattaattacacgtaatcatgaaccgggaggaagcatgaaccagtatataggaatataccgccgttgtgagctattatatatacggactgagttggaaaagtatggacttcagcctctggaggggaaaatccttatttttttgcgcaagggatgctgtacccaggaggatgtatgtatccattttgacatggataagggcaggattgccaggaacctgtcggaactggaggagaaggggctggtctgccgggttgtgaatgaaaataataaacggcagaagctggtaagcctgaccttgcaggggaatcagatcctgtctgagatagacaggatttttgaaaaatgggatgctgtctgcttttccggttttacggaggaagaacgctgtctgtaccaggattttgtcaagcgcattgccgaaaacgccatggaatacagacacaatcaaatcattcagagggaaggaagtacatatgataaataacctgacagaggggaaacctttaaaactactgtttttctttgcaattcccatggtggtgggaaacctgttccagcagctttacaacatggtggattccatggtggtgggccggttcgtgggcgaggacgccctggccgcggtcggctcatcctttccggtggtattcctttccgtggctgtggcggccggactttccatgggatgtaccgttgtcatctcccagttcttcggagccgggaaaatcagggaaatgaaggtgacggtgtcaaccgccctcatatcccttggcgtaatcggacttatcatcatgggcatcggggaactgtcctcctttccgctgcttaagcttttgggaacggacccggatatcatggcggattccctgtcgtacctgaggatttattttggcggtgcagtgttccttttcctgtataattccctgaacggtatctataacgccctgggtgacagccagaccccgttaaaattcctgatggtgtcggccctgaccaacattgtcctggacctgctgtttgtcattaagttcaatatgggggtggccggggtggcatgggcaaccctgattgcacaggggctgtgcgcattcatctcatttttcgtgctggttggccggcttcggaggatggaggatgagccttgcgccaggggaagggattttgccttttttgacatggatgccgcaagaaggattgcaaaggtaggggttccctccatgctacagcagtccattgtctctgtcagcatgatgatgatgcagggactggtcaattcttacggaaaagtatttgtggcaggttacacggcagccactaagattgataccctggccatgctgccgaacatgaacttttctaacgcaatgtccagttatacggcccagaacatcggggcagggaaggtggaccgggtaaagcaagggtataaatcctgcatgttcatggttttcatattctctgtaatcatcaccctgctcatctacctgttcggaccccagcttctgggactgttcctgaagcagggctccgagggcagcgccatgagctacggccttaaatatatgaagaccgtatccgtgttctatctgctgatgggcgcactgtttgtgggcaacggcctgctgcgcggggcaggggacatgggggcgttcatgctcagctccgtcgtcaacctgtttgcgcgcgtggcaatcgcttacctgcttgcacactacataggcgccagcgctatctggtggtccattcctacgggatgggcaattggattcatattctcccatctgagggttaagagcgggagatggatgtccaaacggctggtggattaaccgggaaatgatgctcagatgactgatggattaaccgggaaatgatgctcagatgactggtggattaaccgggaaatggatgttcagacgactggtggattaaccggaatttgggcaggccgtccttaactgcgcagtggatacatttccgtattaggattgcctgttgctgcatataattcaataaatacaggctcaggagcgcgctttggatatatatgtggtaaaacagggagacagtgtggattccattgcaaaatcatacaatattcctacagaaacattattatgggacaatcagatagagtacccataccgcctggccgttggccaggctctttatatttctgacggtaatacggtggaggggaggaaactgctctataccagcggatatgcgtatccgttcatcaacgaggaggtcctggaggaaaccctgccgtatctggatgggatgaaggtattttcctatggctttaccctggaaggggaattaatcccgcccatcagcgatgacgcgtggatgatagggcgggcgcagcaatgggggacgcggcccatcctgacactgacacccctgggggaagacgggcattttaataataatctggtatcggccctggtgcgcagccacgagctgcagcagcggatcatatgggaactgggcaggaccatgcaggataaaggctttggcggtctggacatcgactttgagtatgtgctggccgatgacagggaggggttcgccgcatttgtgggcctggccaccagggtcatgaacctgtttgggtatccggtcagcgttgccctggcccccaagacctcggctgagcagaggggacttttgtatgaggggattgattacgcccttttggggtcggctgccaaccgcgccatgctgatgacctatgagtggggatacagccagggtccgcccatggccgtggctcccatcaacatggtgaggcgggtggtggattatgcggtcaccgccattccaagggataagctgagcctgggcatacctaactatggatatgactgggcccttccctatgagcggggcgtgaccagggccaaaaccatcaacaaccatgaggcggtgcagcttgccattgatttcggtgtggatatccggtttgatgagactgccatgtcaccctacttccggtactggcagtatggagtccagcatgaggtgtggtttgaggatgtgaggagcatcaaggccaagttcgaccttatcagggaatatgggctgtcaggggccggatactggcagctgatgagccttttcagggccaactggctgatgctgaacgagatgttctacattgaaagggagtggcctgtgatggaacggctggatggggcagatggaacataaggatattgcggcagatatgggaggtggggaaaccgcattgtcttgctgaatcctttcattgtggtataatagaccaatacggattgataggatggatgacacggcaggagggcatatgggaatgaagattgacgcggcaaaggtgatggaactggtaaggacggtcaaaccactgttcctggaccatgagcaggcagccaggattgaggtcaaaggtctggctgattttgtgacccaggtggattttaaggtgcaggagatgattcaggacgggcttatgcagctgtatccggatatccagttcatgggcgaggaaaaggataacagcgacattgattttaccgggccggtgtggatcctggaccctgtggacggaaccaccaacctgatacatgactacaggaacagcgcattgtcccttgcattttgtgacaaccggcagctggaactgggaatcatttaccagccctataccgatgagatgttccatgccgtccggggaggcggggcgtggcttaacggcaggcctatccatgtgagccgggtggataccatggagcggagcctgatagccattggcacaagcccttatgaccatgggctggcggacaggaatttcagggatttcaaagaggtgttcctgcgctgctccgatatcaggaggaatggctccgcggcccttgaacttgcccatgtggcctgcggccgcacggatgcatattttgagcaggtgctacggccctgggattttgcggcaggaatgctgctggtgcaggaggcagggggaaccgtgacggattatgatggggaaccgctggatgtttcaacgccgtgccaggtggcggcggctaatggcctgattggggaggaactgcttgtaatcctggggaagtgataggacagacggtaagatgataagagaataggatgaaaagagaataagatgatataatcagaagacatgccaggcttacttccagggcatgtctttctgatattcaaaataaaccctcaggagctggctgcgcttggtcacatttaccttctggaaaatgttgtgcacatgggtcttgaccgtaccgatggagatgaacagcgcgtcgctgatttcctggttgtttttatccgtgagaagaatcctcaggatatcctgctcccgggaggtgagctggtagtggctggcaaaatgaaggaatacggtgttgctgtccggcccatccggctggatttgccccttgctgtcagcctgtccctgcgttctgccatccgggagggtggaggtgggcgtcccgtccttcgtcatcacctgcgtcccatcctccgtcatcacctgcgccccgtcctccatcatggctgtcctcccggtatccgctgcgggagccgtgcttccggccatgtccggggcctggattttaatgagcggaccctgcagctgccgggtcaggtatgcaagggcatacactgaatacaggatgctcatcatgtcctcagagaggctgcggttgttgatcttgaccatgatatccgagtagacgtcaaaggaaaagatgacgatggtgtcttcagccagtatcagtagggaaaaaacagcggtgatccagagcaggcttttataggcatgcatttccctgtccagctccccgggatgctttttcaggtacagcagtccggaaacgctcagatacaaggtaaagagctgggccggaagatagtagagccataccttgaacgcgccgtatcccgcagtggggatgaacaggaggctgagtcctaaaagcaccagcgcggctgtatcccggttctttgggcgccgggaaagcacctgatgctggatggaaaccaggcagaaggaggttaccaggaaaatcagtgtcttaaaggcaggcgcactcatgaactgcaggtcatagcggacagagaacccatctaagaattcagtcatgtagataatgatgttgtcaaatatataaaaaaggaagagaacggcggttgcggcagtcaacggcctttttttgtgcctgtaattaatgatgcagaaggtaagaaccactgtataaagaacaataaggaaaatgttgtaaatgaaaatcagtatatccatgaaatcctcctctgacatgctgctgtatccggcagttaaaatatatcaaaaaacagaggatttagcaaattgtttctttggatgaattgaaagaaagttgtgcattatgcataaaaagtttagggaagtttagttggtttatgatgaaagtatgaataaaatcatcctttttcatgagggaaaaggaagggggcatatatctgcgaatccatcccggggatgattttaaaccctgtcccagggcgctatgatgatatcacaaggcgccggacacaagaagccttaggacgcaccctgtatgtgattcataaatacgcttatgatccataacaggattcgcatccataacaggcttcacctccggacgtaggaaaaacaaaaaacatattattaggaggaaatgaacatgtcagtaaaggatttcatcgacacaaacgaatttaccaaggaggagctgatggacatcatcaatctttcattaaagattaagaggtgcatcaaggccggttactatccacaattattaaagaacagatccctgggcatgattttccagcagtcatccaccaggacaagggtttcctttgagacagccatggagcagttaggcggccatgcgcagtacctggcgccgggacagatccagttaggaggacacgagacaatcgaagacacaagcgctgtgctgtcccgtctggtagatatcctcatggcacgtgtggaccgccataagagtgtggcagacctggctaagaacgcaaccatcccggttatcaacggcatgtctgattataaccacccgactcaggaaatgggcgatctgtgcaccatgattgagcatttaccggcaggtaagaaattagaggattgcaaggtggtattcgtaggcgacgccacccaggtatgcgcttccttaatgttcatcaccaccaagatgggaatgaatttcgtacactttggaccggaaggctatcagttaaatgaaaaccacagggcaatcgcagaggcaaactgcaaggtgagcggcggtaccttcctggttacggataatgaagatgaagcccttaaggatgcggatttcgtgtacacagatgtatggtacggcctgtatgacgcagagctttccgaggaagagaggatggctatcttctatcctaaataccaggtgacccctgccatgatggccaaggccgcgccccatgtgaaattcatgcactgtctgcctgcctccagaggggaagaggttgtggatgaagtgatcgacgctgggtattccattgtgtttgacgaggctgagaaccgcctgaccgccatgaggggactgcttgtatatttcctgggacaggctgagaaaaaagcggacgaagaggaaaaagcaaaggcaaaggctgacctggaagtattcttaaaaaaggcgctgtaatttagcatgaaaagggggcaagacacatggctgaaacacacggaaagaaaaaatttaaattgacagatgcaatcctgtccgttatctgcgtcgtattcgtggcagaagcagcggcgccggtggctgcaatcggaaactcccagtatttctggtggattttcctcatgcttaccttcctgctgccctatgggctgattgcctcggagctgggcactacctatgacggggaaggcggcctgtatgactgggtgagaaaggcctttggcgccaaatggggaacacgggtttcctggtattactggattaacttcccgttgtggatggcatccctggcagttatgtgcccggaaatgctcagtatcatcatcggacatcccattggggttattccctcattaatcattgaactggcatttatctgggtgattgtggctatcagctttttccctgtgtgcgacagcgtgtggatcctcaacggcgctgccctgattaaggtgctgctggctgtgattgtaggcggacttggcatatacggggcagtgacccatggagtggccaacgagtacacggcggcttccctgatgcccagctttgatgcgaagagcctgtccttcatatccgtcatcctgtttaatttcctggggttcgaggtggtgtgcacctttgcaaacgatatggagaatcccaaaaaacagattccacaggccattgtttcaggcggccttgtgattgcggcaatctacatattctctgcctttgggattggcgtggccatccctaccgctgaggtcagcaccagcagcggccttattgacagccttcagctgctgaccggtaagaccggcgggcttttcatctccatcatggcagtcatgttcgtgctcacgctgttcggcaatatgatttcctggtccctgggcgtgaacaatgtggccagctatgcggctgaacagggtgatatgccaaaggtatttgccagaaagagcgttaagaacggtatgccggtgggagctgccgtgatgaacggcattgtggccagcgtggtcgtggtcattgcgcccatcctgcctaaccaggatctgttctggagcttctttgcactgaaccttgtaatgttcctgctggcatacctgcccgtattcccggcgttcctgaagctgcgggccattgacccggaaacggagcggccctttaaggtggggggaagcagggcattcttaaaggtgctggcagcccttcccatgatcatgattgtcatatccctggtattcattgcagtgcccatgagctttgacgcccagacattaaatgaagtgctgcccattaccattggatccgtcgtgttcatcggcgtaggggaaatgctggcagccaaaaaggggaagggactcaggcccggcggggctgccatggaaaaggcggcgcagctgtaagaaaacgtgaaataaggcataaaaataaaaacaaaatgagaggaaggtattttacatgaaaacatatacaactaccccaaaacaggacggtttcaggatgccgggagaatttgagccgcatgagggctgctggattatctggcccgaacgcccggataactggagactgggcgccaaaccggcccagaaggtgtttgtggaggtggcaaaggccatcagccagtttgagccggtgaccgtgtgcgtaagcaatgcccagtatgacaatgccaggtcccagcttcctgaggatgtgcgtgtggtggaaatgtccacagacgactcctggatccgcgactgcggccccacctttgtgaccaacgggtctgaagtcaggggcgtggactggtcctttaacgcctggggcggactggtggacgggctgtatttcccatgggataaggacgaccatgtggccaggaaggtctgcgacattgagcgcaaggacagataccgtctggatgactttatcctggaaggcggctccatccatgtggacggggaagggaccctgattgtcaccggggagtgccttttaagcgagggcaggaactcccatctcacaaaggaagaaatcgaacatgtgctgaaggagtacctgaacctggagaagattatctggattccatatggcatttacaatgacgagacaaacggacatgtggacaatatcatccactacattgccccgggcgaggtcatccttgcatggaccgatgacaaggaagaccctcagtatgatatctgccagaaagcatacgccgtgctcagctctgagacggatgcaaagggacgcagtcttaaaatccacaagctgatgcttcccaagaacatcctcatcacaaaggaagagagcgagggcgtggacgctgtggacgggacgcttccgcgtatggagggcgacaggctggctgcttcctatgcaaacttctatatcgccaacggcggcgtggtattccctatgttcggtgacgagaacgacgagaaggccagaaagacgctggaagaatgtttcccgggccgcaaggtagtcgggctttacgccagggaaatcctgctgggcggcggcaacatccactgtattacacagcagcagcctaaggcatgagccattgcgcacagaggatagggatgccggactggacgtaaggacaggtaaggatagcggacaggcagagatggcggacaggaaaggatggctgacagaaaaggatggctgacagaaaaaaatagctgacagaaaaaaatagctgacagaaaagaatagctgacaaaaagggagagggtacattatgtcaagaatcgtaatagccctgggcggcaatgccctgggcaatacgccgaaggagcagcaggagcgcattgacaatgcggctccggcccttatcggcctcataaaacagggccatgaaatcatcatcagccatggcaacggcccccaggtggggatgatacgccaggcatttgacacggccagcgcggtggatgggaaggttccggcctttgacctgccggagtgcacggccatgagccagggctacatcggattccacctgcagaaagggattaagaaggaactgcgaagggaaggcatgccgtggcatgtggcgaccgtggtgacacagattgtggtggacaaggaggatcctgccttcttaaatccaaccaagccaattggcagtttttattcaaaagaagaggctttaaagatgatggaggaaaatccgggcctttgcatgaaagaggatgcaggcaggggataccggcagatggtggcgtccccaaggcccatggatatcgcggaaagggattccatcttaaacctcctggaccatgagttcattgtcattgcctgcggcggaggcgggattcctgtgatccttaatgagaacggggattatgaaagcgtgcctgccgtcattgacaaggactttgcgtctgccaagctggcggaactggtggatgcggattacctgttcatcctcacggcggtggaccgtgtggcggtcaattacgggaaacccggccagcgggaactgaaggaaatcacggtggaggaagctcagggattatgcagccagggccactttgcaccgggcagcatgcttcccaaggtggaggctgccatggaatttgcacgcagcaaaaagggcaggaatgcggtcatcgcatccttggaaaaggcaccgctggccatgattggggagagcggcaccaggatagcccttgggtaatcagatggaggatttagtgctcagataaaggcagccctatatagggacagccccatgggagatgtgggtaatcatatctcatcggggctgtaaggaaatctgcttgccatgaaccactgacttatagtataatttacaaaaattaaatccaatacaaaggagtgttcttacatggcaatcagagttggaattttaggatatggtaatctgggaaggggtgtggaatgcgcggttaaacacaatccggacatggaactggcggctgtttttacaagaagggatccgcgcagcctgaccatcctgacagagggggcaaaggttttatccgtggatgatgcgccttccatgaaggatgatatcgatgtgatgattctctgcggaggcagcgccacggaccttccgggacagacgccggacatggcaaggtattttaacgtcattgacagctttgacacccatgccaacatcccgcagcactacgacgcggttgacaaggccgcaaaggagggcggacatgtgggaatcatttccgtgggctgggatcctggcatgttctccctgaaccgcctgtatgccaacgccatcctgccgggcgggaaggattataccttctggggcaagggcgtgagccaggggcattcggatgccatccgccggattgaaggggtaaaggatgccaggcagtacaccataccggtggaggacgcccttcaggcagtgagaagcggggcagggccggaccttaccaccaggcagaagcataccagggaatgctttgtggtggcagaagagggcgctgataaaaaggccattgaagaggcaatcgtgaccatgcccaattattttgccgactatgacacaaccgtccatttcatatcggaagaagagctgatgcgagaccatgccgggattccccatggcggatttgtcatccgcacgggaaggacgggctgggaggatgaacacagccatgtggttgagtacagcctgaagctggactccaacccggagttcaccgcatccgtcataaccgcatatgccagggccgcgtacaggctgagccgtgaagggcagactggctgcaggaccgtattcgacattgcgcctgcatatcttagcgcccaggacggggctgaactgaggaaacatctgctgtaaatgcagacaggactttatcatgcaccaatccctcccattcctcataccataatacaaacggatatggggattggatgacatccattcccgccatccgtatctattgcactgcatatattgctacagtacaatctgatcaggccttaaaatggatggaacatccatggaggagccgggccgctttagcggcagcaggtaggaaacacctgcgggacagtcgtttactcgtattgtcccgcaggtgtttttttattatccgggccgtgtactgttttatgggagggaaagttatgacaggaactgagttcacaggggaacgcctgatagggaaatgccgtacagggaaatttcatataggagggcacaaccatacaataaaccacggaccgggcgggcataaagataccgccatgcacgtctcaagggtcagcattgcagtgaacatggtcctgacagccggaaagctggcagccgggatcctgggccactcccacgccatgatatcggatgcagtccattccgcgtcggatgtgttcagcaccctcatcgtgatggcaggggttaccatgtctgccaaacagtcggataaggaacatccctatgggcatgagcggctggagtgcgtggcggcgctgttccttgccttcatcctgtgtgccacggggctgggaatcggctttggcgcggtaagggaggtgatatcaggggaagtgaaggatgcggccataccagggcttatggccctgatggcagccattgtctccatcgtggtaaaggagtggatgtaccgttataccataaaagcagctgattccatacactccagcgccttaaaggcggatgcatggcatcaccgttccgacgccctgtcctcggtgggggcgtttgcgggcatatgcggggcgcggatggggtttgccttcatggacccggctgccagcattgtaatctgcctattcatctgcaaggcgtccctggatgtgctgcgggacgctctggacaaaatggtggataaggcctgtgatgaggagacggaaaaagccataaagggaactgtgctcacatcccccggggtggtgcggattgacggcttaaagacccggctgttcggccccaggatgtatgtggatatcgaaatcgcggtggaccctgaccttaacctgcagcaggcccatgccatttcaagggaggtacacgatacggtggaggaacagttcccccaggtaaaacactgcgctgtccaggtcaaccccctcaacagggaaggatagggaatcccggaaaaaggaatggattctgtttgacggacagaccggaattatctatacttagagcatatctgaaagacacttggaaaaacagattaaaagtatgaaacaggagaatatgaaatacgatgacagaatggaaaaaaacaatatgcccttatgactgccccacctcctgcggcctgctggtgaaaacggacggaacccggatattggaggtaaaaggggatccgggccatcctgcctcccatggactgatctgcaggaaaatgcacggttatgcggattccatccattcccccagccggatcctcacgcccatgaggcgggtaggggaaaagggggaaggcaggtttgttcctgtttcctgggacgaagccatatcggagataaccggaaggtggaaggaaatcctcagccgggacggaggggatgccatccttccgttttactattcaggggtcatgagcgtgatccagcgcaaatgcggggatgcctttttcaacaggatgggggcatgttccctggtcaagacgctttgttcctcggccaagggagccggatatgaggctgtcatgggccacaccggatgcctggacccaagggagcttaagcacagcgatttccttctgatttggggcagcaacatgaaagccaccaggatccagtccatgccggcactggacagcgcaaggaaggctgggaaacgggtggtgctgattgaatcatgtgcagaagatatggcgccctactgcgatgggaccattcttatacggcctggtacggacggcgcccttgcactggccatgatgcatgtgctggtgagggaaggcctggctgctgaagattatcttcgtgaatggtcctgcggctggcctgggtttaaggagacattgcccgcctatacgcctgtgtgggcagaggggataaccgggatcccggcagatgtgacagaggcactggccatggaatatggacgggcctcccggcccgccatcatactaggaagcggtccttcccgctatgggaacggcggtatgaccgtgcgcctgattaccatactctccgccctgaccggggcatggggcaggccgggaggcgggctgtgcggatgcaatcccggtatcggtccctgtgtggacgataccattgtgacgcggcctgatttcaggacaaggcagggcaggaaggtaaacatcaaccagctggcccaggcgctgaacgggagtcatgggcaggatcccattcaaagcctttatgtgtatggaagcaatccggtggggtcggtaagcagccaggcggaaacagtgaaggggcttatgagacaggacctgttcacggttgtccatgagcggttcatgacggacacggccaggtatgcggatatcctgctgccggccacattttccgtggaacagccggactgttatctggcctatggctactgtacctttggtacggcttataaagtcctggaaccggcgggacagtgcaggagcaactggaacacgttccggcttctggccggggcaatgggatatgaggaagcgtattttaagaagactgaggaagggatggtggaagaactgctggcccatcccggaccagggctggccaaagcaaccgacagggaatgggatatcctggaaaaaggcggcgtcatctccacgccctttgcggaccacatggactttaagacggagacagggaaaatcatgattgtgaacccgggccagcctgaacccatgccgcggtatacatccgcccacggcggggaataccctctgcggctcattgccgtacccagtggatataccctcaattccattttcctggaacgggaggacctgaccgggaaacggggtcccatgaagctgatgctgcaccctctggatgcggctgggcgcaatatcggggatggggataaggtgattgcatataacgacctggcccaggtggaatttacggccagccttaccccctgggtggccaggggcgcggtggctgtggccggggtatacggtatgtccctgtccggatccggcctgctggtcaacgcccttcaccaccagcgcctgtccgatataggggaagcgaccacgttaaatgacaataccgttgaggtccgtcctgcatttcatcattaaatgtataaaataccattttcaggtacatactgttattgggtataagccaaatgtccacaataaggaggttaacatctatgggaaataaggctttagattgtacagccctgacagtaagcctgattggggcgattaactggggactggttggattttttaactttaacctggtatcatggattttcggaaatgcttcctggattaccagggtcatttatgcgctggtcgggctatgcggactgtatctgattacattctattcacgtacaggacaggaagcataacaggatacagtaaaggcaggaacctgtggggaatcggattgccaaggcagaccggtgcatccgggttcctgttttcgtatgttcctatttatggtaccgtatcccctctgattctgtttcggtactccctgggtgagagtccggtcagcttcttaaacacatcgccaaagtagttgccgtccgaaaacccgcaggcaattgcaatggaagtcactgtcccatctgtgttcctcagcaggtcggacgccttctgcacccggatataatttacatattccttaaaacagaatccggtggatgccctgaacttccgggaaaaataagtggggctcatattggacatggcagccatggcatccagcgtcagatgttccctatattggaggttgatataccgggccgccttcacgattgccgcctccgagtcattgagggagtccttttcctgctgcgtatcctggcagcgtcctatgaggaccaggatttggaagagcaggctctgctgctgtacgtgggaataggcatcctcctgtccgttttcgtgggacagatggcctaacaggccttctatcccggggcgcaggggctgggggatggcaatacggggatttaagaagacgcgctcaaagccttcccgtccgcaggacgcatggaaggcatcggcctcctccttggtaaaatacatatcataccgctcagcctgcagcccttcctcatacaaggccctgtggatctgaagcggcggtatgatgaccgcatcacctggcttcaggtaataaatatcctggtcaatgaacattctgcactgtccggagagcagataatatatctcataataggaatggtagtggggacgtttcatgacatagctggatgaacggcggatccggctgatctggatgctgtttttagcggccggaccgttttttgcagctgatattctgtgcggatgaatggccatctgtgattcctccctgctgatatgtttccctcatctgtccgcccctccatcctggcagagggtgaaggcaaaaaaactgtagttaatcctgaaaaacatataaaatccgtattaattgctgtatttttgttatatcataaggtcacaaaacagtaaagtgaaatcatctgaaacaacaggatggactctgaaaagaaatggggaatcagtatgatgcgtttgtttagattaggaggggacacagggaccggatcaggggccagggaagtatcaggggatgggatcatggatgcggatagggtgctggcggcagtgccggcagtggatgcagtgtatgtgaagcatccgggacatcttacgtttcagggggccaggcggcttttgtccggggggatacatgtgataatggaagggatatccggctttgaccgggcacaggtactggagttacagatggcggccgatgatgctggcgttgtctacacagaagcctttaaggcagcagccaatccctgccttcacggccttaagggggaaatgcaccgtcttggacgcattaaccgcatgacattcatgtcctgcgcccgtacgccgcgtcatgagtgcagggaagaagcggcggatacgctgcctgcgccagatcttgcccatggggcgctggtggagcggggggccgactgtattttcaccatgattgcatgctttgggataccggaacagattcaggcagaacctattttctgtgaaaacggcatggacattgccggaagcgtgcagggcaggtatgaggggaaaggatgtaaaggggcggaggccgaaatcctctattcccaggtgtccgcaagccatgtgcccagccagatcagaggggaaaaaggaagccttgtcatacgcagcattgcagatccgtcggaactgtgtttttacggccgggatggggagaaggaagtgctggccctgcgcacatctccggtcattacggatgaagaaatcaggacgtggattgccagggcctgtctgggaattcattcccgtcatcggtatgtcccgcttcgcggcatatctggcccaaaggatgggggaggctatggggaatggcgccaaaacgtgctcatgacccatgaggtgatggacaggatccgttcgcaggtgttataatgaaagtcagtgcaccggcgctggggtgtgttggaaactttctttccgccgtgggcaccagatctatcaatggaggcgggatatgaggaaagcggcaaaagcaaaggggatattggcacttacgttactctgttccctgttcctgtgcatcactgcatatggtaactggaagaatgaaggcggccaatggcactattatgacaaaaacggacagatggtgtgcaatgatttcaaaaagtccggcaattccatgttctatctggatgaaaccggcaatatcgccaggaactgtgagaaggtaatcggcaattacctgtaccggtttgatgcagacgggaagttcacgcgttccaggctgggagaggacggccagccggagtacctggaaggggattacgccctgaaccaccgccagcagtacctgaacaaaaaggccaacccctataacgacaaccaggtggtacagtggtttaatgccacctacgccatcctgacaaagcataacagctgtaatatccgggcctatggcggtgaactgctgctggctggcgtggagggggaggacgatggcagctccgacaattcaataaaggaaaggaacaggaaaatgctgtcaaaaagctggggggtcactgaccgggccagcgcggacgcggcccttctgcggctgctggagtcaggcagggccaccggctcggcatgggattacagccgcgccatgtcaaacctgggattttactatctggcggggtattatcccatcaccgaatccttggaccgttccctggaggttgccagaaccatacagcagacctatggctcctgggatgaattcattgccagctacctggcaggataccatgcctgggccggggatgaggcggaaaacagggatttaatctatgaggggctgaagggaagtgcgtttaacccctatgctgtggactggaacctggaacttaagaagacctggtagatatcatgaaccggaatatggaggaaacagaatatgagatggggcatcatggcaaccggaacaatcgctgcaaaatttgcagacacggtgatgaaaatgggaggagaagagcagctgacagcctgcggctcaagatccatggaaaaggcggaggaatttgcaggaaggtacggtatccggcatgcatatgattcctatgaggcccttgcggcggacccggaggtggacgctgtttatgttgccacgcccaacaacctgcattttgacaattgcaggctgtgcctggacgcggggaaacacgtgctttgcgaaaagccctttaccaccagcgcggacgaggccagaaggctgttcggcatggcaaaggaaaaggggctgttcatcatggaggcgttctggatccgccaccttccgctcttaaagaagatgcaggaactgataaaagagggcgtgatcggggatgtggtctatgccagaagtgattttgggtttaccgcccagggcgccaggaaggacaggaagtttgattccgcacttgggggaggcgcgcttcttgacatcgggatctataacctgggattcatgcacatggtgatgggggatacgaagccttcaggctttacgtccagctatcatatcaatgagtatggtacggatgatttcagctccatcctgttgacttatccaggaaaccgcaccgcatccgtaaccgtgtccataggcatggcaatgccgagggaaggggttgtgtacggtacgtccggctccatccggctgccggattatcagatggctgagaagatggttgtatgcccttacggcggacagccccaggaaatctgcattccctttgaaatcaatgggtttgaataccagatccgggaagccagccggtgtgtgaaggaaggcatgtacaccagcgatgtgctgaaggaaaaggatacgctggccgtactggaactgatggatggaatacgggcatcctggggacttaagttcagctgcgaatcataaagactcaataagaaataagaaaatatttccggcttccacccttgattctgaaatgtggattaatataattaagggtagaagctgtatttttgccaaaaaatgcgctaaaactttagaaaattcatgtaatttttaccattttccgaaaaaacatggaaattattttcctgcagtgttataatagggcgatattatatacaaaggagtgatagttacatgaaagatgaaaatggttttaaaccatttataccggcagataaggtggttccggagatgactggggtatccataatcctgggtatactcctggcagtgctgtttggcgcggccaacgcatacctggggctgcgggtgggcatgaccgtatccgcgtccatccctgcggcagtcatatccatgggagtcatccgtgtcatattaaagagggattccatcctggaaaacaatatggtgcagaccattggctcggcaggcgaatcagtggcagccggcgcaatctttaccctgcccgccctgttcatgtggatgagcgaatggggtgagggggcgccgtccctggttgagatttccctgatagcgctgtgcggcggcgtcctgggcatactgttcatgatacccctgcgccaggccctgattgtaaaagaacatggaacacttccgtatcccgaaggcactgcctgtgccgaggtgctgattgcaggggaacagggcggttccaaagccggtgtcgtatttgccggaatggggattgccgcattttataagtttattgcggacggtctgaagctgttccccagcgatgtggactatgatatccgcaaatacggcggcggcgtgggcatgtccgtgcttccggccctggcaggagtgggatatatatgcggttccaagatttcctcctacatgttctcgggcgggatcatttcctggctgatactgatgcccatcatcaagctgttcggaagcggacttacggagccttttgcaccggccaccgcattgatcagcgatatgaacagccaggccctttgggggtcttatatccgctatatcggcgcaggagccgtggcggccgctggtatgataagcctgattaagtcccttcccatgattgcctccacctttatggacgcaatgcgggatttaaagggcggccgccagacctccaccctccgtacggaccaggatatcccaatgaacatcgtgctcatgggcgtgctggccgcggttgtggtcatctggctggtgccggctgttcccgtaacctttgtgggggcgctgctgattgcagtattcggtttcctgttcgcagctgtttcctcacgtctggtaggccttgtgggctcctccaataacccggtgtccggtatggccattgcaaccctgctggtatcctcccttgtactcaaggctgtatccggttcaggccacgacagcatgatgggcgtgattgccatcggcggcgtcatctgcgtcattgcagccattgcgggcgacacctcacaggatttaaagacaggcttcctggtcggctccacgcccaagaagcagcaggctggtgagcttatcggcgttgtctcatccgccattgccatcggaggcgtgctgtatctgcttaaccaggcatggggctacggttccaccgagcttcctgctcctcaggccatgatcatgaagaccgtggtggagggcgtgatggacggcaaccttccatggaatatgatcctggcaggcgctgccatcgctgttgtgattgaaatcctgggcatccccgtaatgcctgttgcggttggcctttacctcccgcttaggaccacgtcggccatcatggtgggcggcctgatccgtcactggtatgaaaagcgcaggtttgcaaaggaagaggacaggaaggaagctattgacaagggcgtcctctatacttccggtatgattgcaggcgagggactggtgggtatcctgttggccgtgttcgccatcgtacccctggcaagcgcaaggggcggtttcctggctgatttcctgaacctttccgccatggacaacgggctgggcgcattcctttcaagcccggcatccaagcttgtatcccttgtggcatttgcggtcctgatgctgaccatgtttaagtttacaatatggcataaagataaaaaataagacagcgctgtcatatccaagtggggcgcgggttaagaaggtgccggattccggcgccttctgtccatatcatatagtgagtgaaaggatggtgcgggtttgggccgtataaagatgaaggatgaaaactatctggagcagattcctgtgaggaatcccggtttcccatggaaggaaaatgaacagggaatcgtgactgttgacatggtccaccggggattttttccgatgcttgcacagaaactgtgggtcactcccaaagtgagccacattaaactggattgcttcggcagctttgtatggaagcagattgacggtaacaggaacctgattgagatcggcgtcatggtaaaggaggagttcggtgagaaatgcgaaccgctgtatgaacgtctggcaaagtattttgaaatgctgaaaaataataagtttgttgaatttaaaaggtgaggaagggctgtgccaagattcccgttccgctgtcctgtgtttttgcaataaaatattctgcacaaatttggcagttaaagtaaaaaatgtctttgctaaatatccttctatcagttatgatagaaaaagagctgtaattgggaggatattttatgaagaatatggaacatttccatgaaatgaaatcactgacaaggacacagaagttttgtcttctttcattgattccggcttattttattgtcataggtctggtggtccagcccttgcaggaaattgtcccaggaattgtgaatatcatcagggaaccggatttcctgataacggattattttgttgttggcggcgttggggctgctttgattaacgcaggcatgctgaccctgatgagcatcgggatcatctactttatgggcatggatatggatggccatacaatcacttccagctgcctgatgttcggcttttccctgtttggaaagaatcttctgaatatctgggcaattcttgcaggcgtatacctgtatgccaagtaccataaaacatccatgaaacgttatatctatatcggcctgtacggaaccagcctttcgcccatcatcacccagatgatgcaggtgggaagccagcctcttgtcatacgcctgttcatagcggtcagcgtgggaattgtcattggtttcgtgctgccgcccctaagtacccatgtccactatgcgcataaggggtattccctctataatgtggggtttgcggcgggaatcattgccactgtcatcgtatctctggttaagtcctttggcattgaggtggaatccaggctcatatggtccacgggccataacacgatgttcgggatccttctgtccgtcctctttggcggcatgattgtattcggtgttgctgtcagggggaaagggctgttcgaatcctataaaaggatacttaaatcctacggaatcggagggactgattatctccgggatgagggcggggccaccactgtttttaatatggggattaacggcctgtttgcaacctatttttccctggcggtgggcggggatctgaacgggccgaccatctgcgggatttttaccattgtgggtttcagttccacgggaaagcatctgaggaacattgcccccatcatgctgggggtctaccttgccagctttacaaagacatgggaaatctatcagccatcccccatgctggccctgttgttttccaccacactggctcctgtggcgggagagttcggaccggtggcaggtatcatagcgggcttccttcactcgtccgtggcgctgaacgtggggattgtttacggcggcatgaacctgtacaacaacgggtatgcaggaggtatcgtagccattttcatggtgccggtggtccagtccatccgggacaggagggcgcgggccagaggagggttatccctgtaataggaaacaatatgaaacaatataaaacaagaaacgtgtcctgtggctgtctttttgtggcagccatgggacacgtttctatttctttatatgtcagaccatcaggagttccaataccaaaacagcggcgcaccctgccagggatacctggaacaggcttttccccctgtaggccaggatgattgcaacggccagggcggctgcgcctgaccacagggaggccgtggcgtgaaggatggccgggaaggtcatgacggacagggttacgtaggggacatagtaaagaaaggattttatataaacatttctgatttccttttttatcaatgtcaggggcagcagacgtatcaggtaagtgacgcctgccatgaccaggatataaagatatacattacggttcatctgcctgttcctcctttaatgggaataggattgcggctgcgcctgcaatcaggatggtgagtataatgattttaaagccggatgatatgtggttcagcgcaggtatccgggtaaacagccagctgagcaccatggatacaaggatgacgcaggtaaggatccggttgcccttggcgggcggtatgaccacggccaggaacatgccgtaaagggccacgttcagggcgctcaggagacgggcaggcagcaggtcgccggagattgcgcctaacagggtgcccagggtccagccaggaacagccacgcacatcagcccatagctgtaaaacgggctcagcatgccggggcggcacacggagaccccgaatatttcatcggtaacgccatacgatattaagaaacggtggaaaaagggaagccctgccttgagtttctgggacagggaacaggacatcaggcagtaccgcaggttgatgatcagctgggcaacggccatttccgcaaagggcgcgccggcctggatgataccgagggccgcaaactgccccgcgcttgtaaggttggtaaatgacatgaccactgcctgccaggtgttaaggcccgcgccgctggccatgatcccgaaggtaaaggaaacagccagatatcccaggccaatgggaatgccgtcctttaatcccgatttaaactgtgttccattgctttccataattacccctcatatgtagaatgatgtggccgggctgtgtggttcactgtatgtaaagccccggcgtcctttccaattatatcaggaaaatcctggttgtaaatcgggtttttcatgaaaaacaggaaatattgcggatcaggctctttcaattaccttacaataccgcggagcgcgggaaccatgaaagccttataaaggaaaaagggttttactggaaaatgctcctgattttttatgatggaggacggatgtggatttggatactggattgccggatagacagaagatgtaaaccaatgagtgaataaagcatgtaaaccaaaatggtttactatatacgagtgctttggaaaaactggaatgaagggagtgaaattcctgatattggagaatataatgtgatatatgcacaaaatgtaacgagatatttgtgcaatatatcagaaaagtatggcattttgaaaaatcatattgacaaccatggcaaataatactatacttcaatcatgagtaaaccggtttaccaaaaacgagataatacggacagaataagagggaacaagcaaagaatcagtaaactgtttgagaagggagtaaacaaatgacaggaatcattgtaacgggccatggacatttccccacagggatattaagcgccatcgcattggtggcaggaaagccggagaacacggccggggtggactttgaggagggatgcagctcatctgatttaaaggaggccatgaaactggcggtggaatcccttgaaggggaggaagtcctgatcctcgccgacctggtgggcggtacgccatttaatgttgcggcggccctgaagcaggagtatacggggaaacggataaaggtcatggcaggcgtgaacatggcatccctggtggaggccgtattctccagacccatgtatgggttagacgggctggtggaggccgtgctcacggcaggcagggaaggcattaaggatctggacggcctgggcaatgatgaggaagggccggagtttgaaggcggcctgtaaacagatgtggtatgatgataaaaagatgaggtgagggagacatgataaaaaagatacatgtggaaccaatcaggaaaaaggacagctaccttgggggcagccttctcaccaaaagggaggtggagtctgccatcggggatgtggtaaggcaggtgcgctgcaatatgaagtactttgggacaaggttcccgtcttccgcggcaaaggaccagacatacggcatcattgaaaacatcgagtggaccgacggcttctggaccgggcttttgtggctgtgttacgagtacacgggggaccaggatttcagacggctggcggaacagaatgtgtcctcgttcctgaaccgggtggaaaagcgcattgaactggaccaccatgacctgggcttcctttactgcctgtcctgtgtggcagggtataagctgaccggctccggggatgccaggaaggcgggcctcctggcagcggataaactgatggagcgtttccaggaaaagggcggtttcatccaggcatgggggaaactgggggccagggacaactaccggctgatcattgactgcctgttgaatatcccgctgctgtactgggccacggaggtaacgggggaccatacatataaagatgcggctgtgcgccactatgaaaccgcatgcaatcatgtaatccgccaggatgcctcggcctaccatacattttattttgacccggagacaggggaacccttaaagggcgttacaaggcaggggtacagcgatgattcggcctgggccaggggacaggcctggggggtatacggaatccccctgaattacaggtatacgagggatgacagcgcctttaacctgtttgagggcatgaccaactatttcttaaaccgtctgcctgaggacgatgtgtgctactgggacctgatattcacggatggttccggccagtccagggattcgtcggcagcagccgtggccgtgtgcggcatccatgagatgcttaagtaccttcctgaggtacacccggacaaggagacctatcaatacgccatgcaccgcatcctccgctccctgatggaggggtacaccaacccggatataaaggaaggcgcgccggtgcttctccacggcgtgtactcctggcattcaggcaagggcgtggatgaggggaatatatggggagactattattatatggaagcgctgatgcgtttctacaaagactggaacttatattggtaaggataaaaggaggaaatcataatgccagtaccgaatatcgtagcattcagaattgacgaaaggctgatccacgggcagggacagctttggattaaggccctgggggtcaacacggtgattgtggccaatgactctgccagtgaggacgccatgcagcagacactgatgaaggccgtggtcccaaagaccgttgccatgcgcttcttctccatccagcacacctgtgatgtgatcatgaaggcgtcccccaagcagaccatcttcatcgtgtgcaagacaacagaagacgcccttaagctggtggcaggaggcgttcccgtgaaggaaatcaacgtgggcaacatccaccatgccccgggcaaggaagatataagcaaatacattgccctgggagaggaagacaaggcggccctcagggagatgcgggataaatacaaaatcacattcaatacgaaaaccactgcatccggcgatgacggcactgcaaaagtggatttaaataaatacttataataaaaaagggagaataaaggagggaatgatcgtgacaatcagtatgtttcaatgtttgcttatcggtttatggacagcgttctgtcttgcaggtatgctgttcggtatctacaccaacaggtgtcttgtgatggcggcgggcgtgggcctgatactgggggacctgccaaccggacttgccatgggagctgtgggggaactggcgttcatgggctttggcgtgtcccagggcggttccgtgccgcctaaccccatggggcctggtatcgtgggaaccattatcgccatcaccatgaaggattcgggcatcgatgtgggttctgccctggccctttcatttccgtttgcagtggcgttccagtttgtgatcacagccacctatacgtttgccaccacactgaccagctttgcctacaaggccctggataaaaaggacttcaggggttttcgcatcgcggccaatgcgacggtgtgcatattcgcaatcgtgggtttcatcattgggttcggaggcgcattcagctccgaaggcctttcaaggatcatttccctgattccggcctggctcagcgacggcttgggcgtggcagggaaaatgcttccggccatcggctttgccatgatcctcaatgtaatggctaaaaaggaactgatcccgttcgtgctgctgggctatattgcaatcgcctacctgaaccttccggtcatgggcgttgcagtgatcggcaccgcaatcgcattacttgtattctttcacgcaggcaagggcgccggcggatctgtagaagaagtggaggttgaatttgaagatggcatctaatcagttggagaaaaacgattatttaaaaacatccctgcgggcgtatttcctgcagaacggttttaactacggcaattaccagggccttggatacgccaatgtgctgtatccctcccttcgcaagatgtataaggacgatgatgacaagcttcaggaagcattgaaggaaaacattgagttcttcaacaccaacatccatttccttcctttcataacaagcctgcatctggtgatgctggagaataagactccctccagtgaaatccgcaacatcaagatggcgcttatgggccccctggccggaatcggcgattcactggcccagttctgtctggctcccctgtttgcaaccatcggcgcctccctggccatggacggcctgatcatgggacccatcctgttctttgtggccatgaacgtgatccttctgggggcaaaggtgcttacaggcatgtggggatacaagctgggaaccaacatcatcgcaaccctcagcagcaagatggagcagatatccaatgtggccagcatgattggcgtaacggtcatatccggcctggccgtgaactttgtaaagattaccacgcccatacagtatgtggccagcatgcccggcgaccagcagaaggtagtggcaatccaggagatgattgacgccattgcccccaggctgcttcctgtactgttcacaggactgatattctacctgattaaggtgaagaagtggactacctacaagctggttatcttaaccatcgtgattggcgtggtgctttcactgctgcacatcattgcgtgatgtgacgattcatggacaaaacccccggcagtttgatttgcctggggttttgtccgtatcagccggccggacgccacggacagccggacgccacagacagccggacgccacagacagctggacgccacggatggctgtggctgtctgacggcatccggctgcaggatcatgccataccatgaatgaaaacaggaggaggacaacaatgaaacaggaccgattcaccgcccttaaggaacggaccagcggatatatacgacaatatgaccctgcctttgtaacggaatacatgggacggcgctgtcccttggaggcggaaagggtgattgcgcaggcggaccgccttatggagcagacctttacctttgaggacagatgggatatggaaccctgcgccgccccatacaccctgaaggaaatggtctgggatcacagccccaaccaggacccggaatggatattcatgctgaaccgccatgaataccttcataaactcctgctggcataccgcctcacaggaaaacaggcatatataggaaaactggaatggtatatggaacactggatggcatccaacccgatccttcccaaggccaccctggccacccgttccattgacacggggatccggtgcatgagctggcagttccttctggtccatctcataggggaagggcttatgggacagcggcaggcggagaagatactggacagcatgaggagccagtttgcatatatgaggaatggatatattggaaaatacaccctcagcaactggggcctgctccagaccgctgccatctgccacggttttttgtggtttggggaatacctgccggaggacggactttctgagtgggcgtggaaggaacttgaagaccagctggcgctgcaggtcctgccggatggttcccactgggagcagtccatgatgtaccatatggaggtgctgctggcctgcatgaagcttctggcatactggaacggcgatgtgccggaggaaaggacatggctgctggcaaagaccgtggagatgagccggtatgtgatgtacgcggccgggcctgaccattgccagattgcccagtgtgacagcgatgtaacggatgtaagggatgtgctgacaaaagcagccgtattgacaggggacgggcggttccggtctgccggatttgaatccatggacctggacagcgcctggcttttgggacgggacggaatctgcagatatgaacggcagaagccggtgtgtccagagtccaagaacctgcacgcggaggatacgggaaatgtctatgtgaggagcagctggtccgaagacagtcatttcacctatcttaagtgcggccccctgggcagcagccacggacatgcggacatgacccacatttccctgtattataagggcaggccgttcctggtggacagcggaagatactcttatatggaagaagaacctctgcgcccggccttaaaaagcgcccaggcccataatgtgtgcgtgattgacggcgagtcccatgggattcccaggggcgcctggggatatgattcatacggggaatgcctgaaaacatattacagggagcagggaccggtgcagtactgtgaaatggcatatcacggcaccctgtcatccggccggaattaccttgtcatccgccgggtcctcatggccgacccgggtatctggctgattgtaaacgacatagggtgcgggggtgggcatgcactgcgggaatattatcatctggatccccgcgtggaggcattgcaggaagcacatggcatggaagggggatggaccctgcgttccggggacaccggcctgaacctgctgggccggaccgggttcataaaggaaccgtgtgtggtatctgaaacatataaccagctttcgcccagcgcctgcctggtaaaggagacgcggttcacggaccggcatacggactggacctgcctggccggggaggatgtggcgatgggcggcgtgcccgtgtatcagtatggcagcccggaaccggtatccggatcagaagtggtttcaaggacctttaccttatcctccggcgaatcctggatcttcctcatatggaaccgggaaacctttaagggcggtaaaatgtatctctgcaatggaatccccatatacgggaaggcagcagtgattcattgcaggaatgggaatcgcacactttaccgattgagaaattaatggtatagttataaaagttataaatcctttgagctgggtggtggaggtctgtatgaagaaactgacaattaatgagattgctgaacgggcgggtgtttccaaaacaacggtatccttctatctcaatggcaagaccaacaagatgtccgaggagacaaaacagaggatacagcatatcattaatgagacaggatatgagccaagcgctgccgccagggccatgaaagccaagagcagcgggcttgtgggcgtaatcctcggggacagttcggatgcctactgcgcaagggcgttaaagggaatcgaggatgcggcaagcgcccagggatatcagatcatgatgggcaacagcggccttgccttccagcaggaaaaggattatgtggagcgcatgttaaagctgggcgcggaaggtttcatcatccagtccacctaccggttcggtatgctggcaggggatttggagaaaaagaagaagcccattgtctacctggatgcaaaaccctatgactttaagggaagatatgtaaaaagcaataattacgactgtgtctaccaggtaattaccgagtgcataaaaaaaggatatgaggatttccttatgatatccgacggggaggcggccatcagcgcgggctttgagaacacccagggatacaaggacgcccttcaggacgcgtgcagggacgggggcacccagtatctgcaggacggtatcaagtcggcccaggtatatgaaatgctgaaggaaaaggtggatttaaacaaaaagaccctgatttacgtggccagcccgggccagcttcaggtggtgtaccaggcaatccgcaactacccggactatatgggcctgttcccggataccctgggcctggtcggttttgacgtggagggatggaccaggatgaccacgcccgccatatcggcaatcatcacccctgcctatcaggagggggtcagggccatggaggaactggtggatgtgctggacggtaagaagcgggaaggcgatgtggtatttaagaatattgttaagtggagggagacaaccctttgaatatgcagctgtgtgcggcgggactgattgtatgacgtgaatcagccccgccgctgccatctggcggcaggatacgggcctgtacactgccgtcccgtaccctgccagcctgtaccctgccggcccatacacggccggtcagccggaaaaccggttccttaagcagccatggctgcttccaggggcctgcggagcaccggatacagcgcgcatgcgatgaccagtcctccggtgccctgaatcaggttggaagggacgctggccagggcagcgcctggtccgtagaggaagatttcacagaggaagtatcctcccgccaccagcgccatgtcaatcacgccgcaagccgctacggcaaggtaaccgtgccttccctgggcggtaacgccgtggtaaaggtggctgcaggaaaatgccaccagcccttttatgacgaatgtaatgggcacataaatgaaatacccgcctaacaggtccgccatgcaggagccgatcccggctgccaggaatgcctcggctggtcccatgaaaatcccgcagaggatgaccaccgcgtcgccggggtggatataaccgccggtgccgggggtggggatgcggattgacatggtggccacacaggccagggctgcaaagagtgcgcacatgacaagttttttggttgataagcgttccataatacagatacctccttttatcttctgggctggttagggacgcagggggcggggacggactgctgggcatgcccccggatcctgtctgcatccgcctttgccagacgtttgctggtacctactataacggaaaagtggactgagcaaaatatccagttgatgatattttgaccagtccactttttgcggtttttggtttgttcatctaacgtcctggagcagttttcagacatgccctaggcgggacatccgtcccggaaccattgctccatatctcccggcgccgcgaaacggcaggtggaagggatgccttcgggatcatggcagccccacagggccagggcactgtccgttcccgctgccagggcgcattccatgtcgtagacgctgtcccccacatagagcacctgggacggcctcacatcattcatccacatatatgcattcatgggttcggggccaggtttgtgatggaccgtgtcatctgccgtgacggtacattgaaaatatccggcaatcccaaatgggacgaaggtactctcatattggctggcggtcttggaggttatgatgcccaggtcataaccttcgtttttaagatattttaacagggggcggatgccttcgtagacataggctgtgtgctgataggaattcatatacttttcccacaagggataaatcctgaatatcagttccggggactggatgccaagcatttcaaatgcctgcaaccccgggatgccaagcaccggcgccagcttccccacctcccggtgctccccggtcacttccctgagggctttctgcaggctgtggagtacggcggccgtggtatcaataagcgtgttgtcaatatcgaatacaatatgtgaatatctcatggaaacctccttaagtgaaaaatgttgtggatgggtcaggccggatttcctcaggaatgcctgcgggccacggcaaacagtccgttttcatagtcttcctggtaactgttagacagttcgatggcaggaagggccttggccgggataaggccggcgcagccgcgccggatatggtccagctttccctccagaagagggtgccggtaaaggacaatcatggccgggttgacggtaaaggtataaatctggatcagcctgatataaagctccgtcacatccatggtccgcgggtttcgcctcaattcttcccaatacggttccatgaagggaaggaaggctggctcgcaaaaaccggaagtaccggcccaaagccggttgtctatcaccatgcctccgcccatgccgcagctgcccatgtacagcgtgataagggaattggccctgaagcggtagctgttccagcatcccatggtcagatagttcatatcgttatccaacaccacggaaaccggggtgacggacttaaaatgttcaatcaggttaatgccgtgcagacatgggaatgcttcggattcctccaccatgccgcggctgaccagggctgcgattcccactgctgcggccttgagccgttggtggcgccctgcaatgtcaaggataagacggtccagcttctcaagggaaaatacctggaatgaaacctctgcctgttccacaggttcctcatccaggttcttaaggctccaccgcatccgtccctcctccacctggattagaagatagaggcggtaatccgggttcagctgatagtaacaggcgcatcttccgccggtggaggtgccggtaccctgggtgaggacctcgccgccggagcagagttcttccagcaggcgggtaactgtggggaagcttagccccagctgcctggcaatctggctttttgagacggaaccttcctgttccatgaatgtccggatccggtctgtgttgatctgtttgattgatacgggatcttctgttttcatcataacccccttattattggagatattaatatactttttaatattatattaataagttaattccattaaatcacaaaatgtcaggaatgtcaactggctgttgaaatatttccgctgccagttgtgctgtttctgatgtcaggccaggcccggcggggctgaaagtcttgacaaataaaacgggaacgtatattgttacagggatagtggacaaaagagtggaggcggacagacgtggaaaatctgatattcagcttgaatgcaacaatcccggtttttatactgatggtgctgggggtattattcaggaaggcggggctgatggacagccgttttgtggaccagatgaaccagttcgtgtttaaggcggcgcttccggtcctgctgtttgaagacctggccaattctgattttttccatgtatgggataccggattcgtgctgttctgcttcggggttaccctgattgggatcctgctggcagcatgcatttccatgacacttaaggacaagggactcaggggggagttcatccaggcatcctaccgcagcagcgcggcccttctggggattgcgttcattaagaatatttacggaaatgcaggcatggccccgcttatgattattggaagcgtacccctttacaatgtgatggcggtcctggtgctgtcctttacaagaccgggtcaggggaaaatggacggacaggccctaagaggcaccatccggggcgtctgtacaaacccgatcatccttgggatcctggccgggatgctgtggtccgtgctgggtatcccgcagcctgccatcatggaaaagaccgtgtcgagcctgtcggccgtggccacgcccctgggtcttatggccatgggcgcgtcgtttaactgggaaaaggccggaaaggccatggggccggccctctgcgcgtcggccatcaagctccttgggctgaccgctgtattcctccccatagctgtcatggccggattccggaatgaacagctggtggcaatcctggtgatgctggggtctgccaccactgtgagctgctttgtcatggcgaagaatatggggcatgagggggtccttacttccagcatcgtggcgctgaccacctgcggaagcgcctttacattgaccttatggctgtatatcatccggtccatgggacttatatgatgaagggggaaaccgtatgaaggcaagatttgagattatattttccatggctgcgtttggaaccatcgcagtgtttgtaaggaacataggactgccatccagggaggtggccctgtaccgggcggtcatcgccgccctggccctgctcctgtggcagctgtgtacccgccagaccgtcagatggcaggatgtgaaaaaggaactgcccctgctgttcgtgtcgggggcagccatgagcgtgaactggattctgttgttcgaagcctataagtataccacggtagccatggcaaccctgagttattactttgccccggtaatcgtgacagtggcaagcacggtcttattcagggaaaagctgacaggaaagcagatatcctgctttgtcatgtccaccctggggctggtcatggtaatcggtgtcagcggcgggggcggcagccatgacctgtttggaatcctcctgggactgggggccgcggtgttctatgcgtccgtggtcctgatcaacaagggcatccggcacgtatccggtctgaacaggaccttcatgcagttcctggcagccatactggtaatgacgccgtacatatccatgacaggaggttcccacctgggaagccttgacatcaatggcgccgtgaacctgatggtggtgggggtgttccataccgggatctgttactgtatgtatttttcctccctccggtatctgaagggacaggaggcatccatattaagctacattgacccggtggtggcggtcatcatctcggtggcagtgctccatgaggcggtatcgccccttcaggccgccggaggcttcatgatccttggatttaccgtcttgaacgagtgggacgcaggcgccgcgcgccgcagatgacaaggacctggctctggaatggattttcagacacactctggcagttcagtgcggattgctgttccagagcacgtcgcggttgattgtctcatagaacagcctgcgtatttcgtccggatccctggtctgtccaagaatccacatggtcttggtgaccactgcctccagggtcatgtcgtaagcctccagcaggccgaattcctgcttgatgttccgccctacctcgtatacggacatattgctgccctcgttggtgacctgggtggtcatgatcacggtcttgccccggcctgtccagtggccgatggcccggtagtaatcgcccttctcataggaggggaggccgcccacgccaaaggattcgatgatgagcgcgtcaaagtgcccggccatatagtccagaagggacgtgtccgtggagggaatcagcttcataagccccacgttggaatccagttcatggaagaacctgaccggttccgtgctcctgtccttgtcgtccagatagaatatgatatggtcctcctgtatgacggccacattggggaagttgatgctggaaaatgcattatagctttttgtgcgttcctttttccccctggttcctgcaatggcctttccgtcaaacacgatattcacgtcatgcgccctggggtctgaggcaaagcgcaggctgtcggccaggttggtccgggcgtccgtgttttccatgtcaatgggcttttgggagccggtgatgacaatgggcttatgggaatgctggatcaggtaggacagggcggcggctgtataggccatggtgtccgtgccatgggttatgacgaacccgtcatactggtcataatgggcttctatggcagacgcaatggtcagccagtgggacggctggatgttggtgctgtcgatgttcagtatctggatggtatcaatctggcagtaggtcctgctgtccggcacgtaagaaaggatttcctccgatgtgatgaccggctttaagccgcgttccgtgcgcttgcaggcaatggtccctccggtgcccagcatgagaatacgtttcatggtctagtacctcttttcttttgtttttcatagtatatccctaaattaaaaacatataataattaactgtaacaggtttcgtgtcctgtttacaattatattaagaataatataaatttacaatcccttgattgcttttaggcatatctatgatagaatagcagtataaccaattttctccagagtcactgtacttgttggcaaacaaactctaggaagggggattcatatgtctgttgcgtggcttatagcatttgttgtatttctggtagtggagggcatgactgcatcccttaccagcatctggtttgcaggaggggcgctggccgccctggtggcgcaggtctgtggagcgtccttgcggccgcagcttgcggtattcgtaattgtctcatttgccctgttcatgatggtccgtccgtttacaaccaggtatcttcaccggaagaagacagataccaatgtggacagctttaccggccgcaaggcggttgtaaaggaacggattaataacgaggccggtaccggctccgccatactggcaggagagacctggcttgccaggtcggccgtggagggcgtggtatttgaaccgaatacagtggtggtcatcacggctgtcagcggcgccaagctgattgtgaaggctgtggagccggaacataaggtggagctgccgaaggaggatgcctgaagggatatatctgaaggaatatacctgaagggacatacttaaaacataactaataattaactaaaggacaacaacttaaggaggagtaatatgtttggtgcaatcggaggttttctcgtttttatcatcattgccgtcattatcctgttcatcctgtccacgtgcatccgcatcgtgccccaggcccaggcgctggtagtggaacgtcttggagcgtatcaggggacgtacagcgtgggaatccatttcctgatcccgttttttgaccgggttgccaagaaggtgaacctgaaggagcaggtggaggacttcccgccccagcccgtcatcaccaaggataatgtaaccatgcagattgacacggtggtgttcttctatatcacggatccgaagctgtatgcttacggcgtggagcggccgctgctggccatcgagaacctgacagccaccacgctgcgtaacatcatcggcgacctggagctggatgagacactgacgtccagggagacaatcaatgccaagatgcaggagtccctggacattgccacggacccgtggggcatcaaggtgaccagggtggagcttaagaacatcatcccgcccgcagccatccaggaggccatggagaagcagatgaaagctgagcgtgagcgccgtgaatccatcctccgcgccgagggcgagaagaagtccatgatccttgtggctgaaggtaacaaggaatccgcagtgcttaatgcagaagcagagaaggaagcggccatcctgcgcgcggaagctgaaaaggaaaagaaaatcaaagaggcagagggccaggcggaagccatccgttccgtacagcaggcaacggccgacggtatccgctatatcaaggaagcaggcgctgacaatgcggtgctccagttaaagagcctggaagccttccaggcagccgccaacgggaaggccaacaagatcatcattccttctgacatccaggggatagcggggctggtcaagtccattgccgaggttgccgcgaaggacgaagccgcagaataaattccggtagacaaaaatgataatatgatataagatgagaattgacagtagtgcccatcagcgtgttttgactgatgggtgctattttatctgaaataaagaatacgatagcgtgaggatgggttatggagggagaagtcgtaaaaaagaaccggattacggaagggagcatattcggacagctgctgctgttctttttccccatattgttcgggacgtttttccagcagctttataatacggcggacgccatggtggttgggaggttcgtgggtaaacaggccctggccgcggttggcggcagcaccagtaccctgattaatctcctggtgggctttttcgtgggtctgtccagcggcgccacggtcgtcatatcacagttttacggcgccaggaaggcggataaggtccattgggccgtacatacctccattgcgttttccgtaataggcggcattgttttcatgatcataggactggcagggtccccatgggccctggaagccatgaagacgcctgaggatgtgatggggcattcggttgtctacataaggatttatttcctgggtatcatagcgaacctgatttataacatgggagccgggatactgcgcgcggtgggggattccaggcggcccctgtatttcctcatagccagctgccttaccaatattgccctggacatactgctggtggcggtcctgcgcatgggagtggcgggggctgccattgccaccatctcctcccagctgttaagcgccatcctggtggtgcgcaccctgatgaggaccgatgacatgtataagctggaatggaacaaggtccgcatcgaccgcaggatgcttcagcggatcgtgcgtatcggcataccggcaggcatgcagtccgtcatgtacaatatctccaatgtcatcattcaggccggcgtgaacacccttggtacggacaatgtgacggcctgggctacttacggcaaagtggacggcctgtattggatgatgatcaatgccctgggcatatcggtcaccacctttgtgggccagaactatggcgccgggcgcatggaccgggtgcgcaagggggcgggcgcatgcatggtgatcggcgtggtgcttaccgcgtccgtgggagtgcttttgtataacgggggccaccttctggtggaactgttcaccacggaccagcaggtgcaggccatcagcatggacctgctgcatttcatggttcccaccttcatcacttacattgccattgaaatcctctcgggcaccctcaggggcgtgggggatgcctgggttccgctgatccttaccggaatcggcgtgtgcgcggtcagggtgctctggatcatgttcgtacttccgaagtaccacacaatcatcggcgcagccttctgttatccgcttacctggagcctgacaaccattgcctttgtgatttactactatttcttcagcagtctcaggcggtgggaggtaaaacctttctttaaaagaatcaggatgtataggcgttcctgattggggaagactttctgtataatgaacaggaggtacccatatgacgacaagagaggttacatttgattcaatagaggaagtaaaaaaattcgtgaaccaggtagaacagtatcccgaggacgtggatgtgtgctgcgggagctgcatggtggatgggaaatccattctgggaatcctgagcctggggatacgcaagaagctgaatgtggtaatacatgactgatgggccatggtccgttgccatggttcacagggcttacaaaagggcggacgtgggtgttcaggcatgccccaaggcccgtacagccaaaagacggggagcggtgctgtccgcgggaatgcttttgagggttttcccggcggggcgcctttggctcctgctttgatgcaggagccaccccgtttttttgtttacaagaatggaaggggtcccaaaatccaaatataaatccaaatttacatcaatgctttcatgtggtacaatagattccatatcttcaggaaagatgaaaggacgatgacataagatgattcaggacattgcgccgcatacatacgatcctgttttcaggaataaggaacctgaggaccaggattacgtgctgcattatgagtataataaggtgatgcttctcaaacagggggatgggatggccatcccttcctttggagacttaaaggaggaggcaaaggagattaaggctggggcacagtatctgttctccattgacggcagggcctattactgtgtgactgatatggacgtgccggagtttggcgggtttaatctggagcctctcactgttttccgcagcctggaaccgttgcatcaggcgtttgcgggtattaccggaagccagctctaccggtggaggcagagccggcagttctgcggacattgcgggacaaggatggaacccagcgccatggagcgcgccatggtgtgtccggattgcggacagacagagtatccgaaaatcagcccggcggtgattgtcgccattaccaacggcgataagctgcttatgtccagatatgcgaagggggcttacaggaattatgccctgattgcaggattcgtggagataggggagacctttgaggactgtgtgcgcagggaagtcatggaggaagtagggcttaaggttaagaacatacgttattataaaagccagccatgggcgttttcagatacggaaatgattggattcacagcggaactggacggtgatgataccatacgtctggaggaggaagagctgtgtgaggccgggtggtttacaagggacgagatagtggaatacggaccgtatatcagcgtgggccatgagatgatgaaggcatttaaggacggcaggatataggagaggtatatgctgctggatgatgggactgcaggactgctgctatagaggaaaagaaaggattgtgtggatgttatgaatcagaaggattatatcctgtttgacctggacggtaccctgactgatccaaaggaggggataaccaagtcggtgcgccatgccctgaaccattatggaatccaggtggatgatctggacaccctgacgcctttcatagggcctccgctgacggacagctataagaagtattatggcttttcggatgagcaggcatgggaaggggtgctggtgtaccgggaatatttcagcgagaggggatggcatgagaacaaggagtatcctggtattaaggaaatgctggatgcccttaaaaaagccggaaaggtgcttttggtggcaacctccaagcctgaggagtttggcaggaagattctggagtattttggcatggcgggatattttgatttcattggcggcgcggatatggaagagaccagggtgcgcaaggcggatgtgatccggtatgtccttgaacagtatgggcttgacaggacgccagagaccctggcccgctgcgtgatggtgggggaccgggaacatgatgtgctgggggccagggaatgcggcatggactgcgtgggggttctctatggatatggtgacaggcaggagatggatgggtgccggccggcctggattgcggccacggtagatgaattaaaggatttacttttgacattataacctgcactcataataaccattcctattatgcaattgacaaatagaacaatggttgctatgattgaaattactattaagaaggtccacgatagaagacattgtggaacataaggaggggcagtgttaaagctgtccgccatgatgagagggtgggattatatggatgacagaatcgtgttatcgctgcttgtagacaataccgctggtgtgctggcccgggtagccggacttttcagccgccgtggttacaatattgaaagtctgaccgttggcgtcactgcggacccgcggtactccaggatgaccgtggtctcactgggtgaccagactgttctggagcagattaagaaccagcttaataaactggaggatgtaagggatatcaaggaactgcagccggaccgttccgtgtacagggaactgatgatggtaaaggtcagggccaatgccgcagacagacagtccgtcagcgccatctccagcattttccgcgcaaccatcgtggatgtgggcaaggattcactgaccgtcatgctgacaggagaccagtccaagctggacgcgttaatcaacctgcttgaagattatgaaatcctggagctggcccgaacaggcctgacagggctggaacgcggcgccgaggatatcaggatgcttccgtaagttcccgtgcaagggaaagggcggcatggatggaattacataactgttaagtaagagcttaagggggcggccaagggcggactgagagtcgtcggttttgttgccttaacatatacattttcaaaggaattaaggaggataagagcaatgccaaagatttattatcaggaagattgtaatttatcattattggaaggcaagaccattgctgtcatcggttacggcagccagggacatgcacatgcattaaacttaaaggagtcaggctgcaacgtgattgttggtctgtatgaggggagccgttcctggaaaaaggctgaagagcagggatttgaagtatatacggcagctgaggcaaccaagaaggccgatgtcatcatgatcctgattaatgacgagaagcaggcagccatgtacaaggagtccatcgctccgaacctgcgcccgggcatgatgctgatgtttgcccacggttttgccatccattttggacagattgttccgcctaaggatgttgacgtgaccatgatagcgccaaaggctccgggccacaccgtaagaagcgagtaccagaggggcaggggaaccccatgcctgattgccgtacatcaggatgcaacaggcaaggcaaccgatatggcgctggcttatggccagggaatcggcggcgcaagggcaggtatcctggagaccacctttaaggtagagactgagacagacctgttcggcgagcaggcagttctgtgcggcggagtctgcgccctgatgaaggctggtttcgagacgctggtagaagcaggctatgctcctgagaacgcatatttcgagtgtgtacatgagatgaagctcattgtagacctgatttatgagagcggttttgccggcatgagatattccatctccaacacggctgagtacggcgattatatcaccggaccaaagattgttacagatgaaaccaagaaagccatgaagaaaatcctgtccgatatccaggacggcacctttgcaaaggactggctgacagagaaccaggtgggctgccctcactttaacgccatgaggaagaacgaggcagaccagccgcttgaaaaggttggatctgagcttaggaagctgtatagctggaatgatacggataagcttatcaacaactgatcatacatataaggttaggagaaacggatgtccactgagaggggcatccgttttttacatgttatccattgaattgtgggtaaatccatgctaatataacaccatggattgtgtctgcggaacttcttttccgcaggaattctaatcatctgcaatcagcagatatcgggacgccagggcgtttcagaaggccggttcggccaaagattcaatttcagcagataaaatatggggataaggagggatgatgccgcgggattgttgaaaaaaagcagtatttccattataattgaagggagaaggaaggatggtcaacaaaccactgcagtggcactgtgcgttccaggccatattgcagattgaattggaggaggaccaggactgcctccagtttctgaaggagtataatctcacggaaaaacctctgaggattgatacgctggtggtaaaaaagataccgggccaggccgttaggaagaatatcggccggattttcaggcagtataatgtgatggaatacaaaggccccggggattatcttagcgtcaatgatttctataaggtgatgggatataccggtgtcctgcagtcaaatacaaaacgtgagcaggagatacgaccggatgacctgaccgtatccttcataggattccattacccaaggaaactgatcggttttttaaaagcccggtattccgctggggtagaagaggtttttccgggtatttactatgtgtccggtttgatgttccccacgcaggtcgtggtacagaatcagttgtcaaagctggaaaatatatggctgagcagactgtgtgggaatcttggaaggcaggatgatattgaggttctggcaaaggaatacaagggaaaggataaagatcccttgtacagcgctgccatggatttgattgtccgggcaaattggaatgtatacgaggaggggattgaaatgtgtgatgcattgaacgagttgtttgctgaaaaaatggaaaaatcaaaacaggagtggaaggcggaagcgaaagcggaaggaaaagcggaaggaaaagcggaaggaatcgcagaggcgattctggcattccttgaccatctgggggatgtgccggctggtttgagaagacatgtgctgtcccagaagaatcttgaagtattgaataaatggtttgagatagcaataaagtcagatacagtaaggactttccggcagaataccggattatgacggatacttttgcacgccttcctgaatccgggaacccactgcatcatattgccgtcgatgataaaaacagccctgccgcattggcaaggctgttttcatatggtcaatgacgtcccccggcaagcggcaatgcgtcaatataaaaactccaggaatgtcttgagtgccatggcctggttggaagggtggtacgcaaagccgatggtccttctgtggatgggaatctccaggggtatctccaccagggagccgttgtccagctccttttgcaccagttcctttatgacacagccgattccaaggccgatttttgcaaattcaatcaacaggtccatggtggtcacttccaggacctggcgcggcagtatgttgttatccgacatgtactcatccacatggtggcgggtcatgttgctggtatccaggagcatgatgttgccggtctcaaaaatattggtgtccctgccttcccttagatacaggttttcaaggtaggacggggtggtgacaaagatatcctgtatgtccatcacaggtatgaacgcaagatccctgcgcaccgaaggctctgcaaccaatcccaggtcaatcttctgctgttccaggcgggtcagggtcagggccgtggactggctctcaatggttaccttcatgtgcgggtattggtcgatgaaggttttcaggtaagggagcaggatatatttgcacagggtattgctgacgccgatgcgcagatggccgatatcaaattcctggatccgcttaagctccatttccccgcggtccagggcatcaaatgcctccctggtatgttcaaacaggatttccccctccgctgtaagctgtacgcctctggaactgcgggtgaaaagggacagccccaggctgtcctccagcttgctgatggccttgctgatggctggctggctgatatagagttccttggcagccttggaaatattcccggcttttgccacctcgtagaatatcttgtattgtgacaggttctgctccatgattgtcctccctgcaatataacattttttcatatgaaaatgtgtactgtataactttcattataacaacacatgtcctgaaatgtaaagtacggaaggggatgattttcaaggattttaaaaaatgtaattttcctcttttcggttcaccttccctattttccataatatacttataatatatcctcctggatgaaaaactgcagccgtaccggcataggaatggtcctgcaggatggatggcggatttacctgccgggggcgggaggaaggaatgtcccggccaattcgatgaatgcattcatttcacgggtcacccatttatccttatggtagacaatctggcgccaggtctgcatgtggaaatccttcacattaagggccgccaggcagccggattcaatgtcggagaggatggtaaacctgggaaggaaggagacgcccatattggcccgcagcaggttgatgatgaattccgtattcccgatttcgaggaaagggcggatggtcatgtcctgggctgccaggtattgctccagtatgaaacggtagcttgcatttttctcagtcaggatgaagggctgtccaatgacttggggcaggtccaggtccttccggccggaaaatgggtgctttacggaggatacgaatacaatgtcctcaggctcttccaggaccttgatccatttgtcgtcatacatacgcttgtctagaaaatacacgatgtcaatggcattgctgttcatcatgtccagcagggtacctggggaatcggtgatgatgcttacgttaacccgtgggtacagacggtggtactcttttaacagaggggggaagatggatgcacagatggactcaatggtgccaaggcacaggcttccggtcagttccgtggcttccgtcacggcatccctggcgcattccagatcccgcatgatggcggccgcatgttcaaagaacacaacgccctgatgggttaaggtggtctgtttgccaatgcggtcaaacaggtggacattcagctctttctccagctgcttgacctggatggtgacagcggcctgggaatatcccagctgcttggctgcttttgaaaaactttttaactgagctacctgaagaaatgttgcaatctctcgtaattccatagtatacgtcctttttaaattgatttttctataaaaatttttaaactatatcataaaaacattaaattttacaaccatttgtttttatggtacattaagcttaatgagaaatcaataccaaataatgactattttcccaaaaatcagtcaaaaaaagaaaggaatcaaatatcatggaaaaagacaatgtaaagtacaacgcgtatattcagatactgaaggaggaactgcttcctgccatgggatgtacggagcccattgccctggcctatggcgctgcattggccagaaaagtactgggggatctgccggacagggtggttatcggggcgagcggaagtatcatcaagaacgtgaaatccgtgattgttcctaatacagaccatttaaaaggaatcccggccgcggcgacagccggaatcgtggcaggtgacccggataaggagctggaggtaattgcccaggtgacaccggagcagattgcgcagatgaaggaatttatagggaataccgacattgaggtggaacatgttgacaatggcatcacctttgacatcatcgtgacactgtataaaggaagttcctatgcaaaggtgcgtatcgccaattatcataccaatgtcgtactggttgaaaaggacggggaggttttaaaacagatagaagtggccggagaggacgaggagggcctgacggacagaagccttcttaatatggaagatatctgggatttcatcaacacggttgacattgcggacatcaaggaggtcctggaccgtcagatttcctacaacatggccattgcagaggagggcatcaaggggaactacggcgccaacatcggcaaggtgctgcttgatatgtcaggcaatgatgtacgcaccagggcaaaggccatggcggcagctggttccgacgccaggatgaacggctgcgaactgccggtcatcatcaattcaggcagcgggaaccaggggattacggcatcggtaccggtccttgtatatgctgaggagctgaaggtcactgaggagaagaaatacagggcgctggctctgtctaaccttactgccattcatcagaaaacgccaatcggaagattatccgcatattgcggcgcggtcagcgcaggggcaggggcaggagcaggaatcgcttatctgtgcggcggaagctacaaggaaatcgtacatacggttgtcaatgcccttgccattgtatccggcattgtctgtgacggtgcaaaggcgtcctgcgcagccaagattgcttcggcggttgatgcagggatcctgggctataacatgtatatccgcggtcagcagttctatggaggagacggcatcgtgacaaagggtgtggaggaaacacttaagaatgttggcaggcttggaaaggaaggaatgaaggagaccaacgaggagataattaaaatcatgattggagattaggtatgaaaaaaataacaggtagtttaccgttccgattactgttgggtgttatcctcggtatcatcgtcggacagatttgcggcgatggtcttatgcacgtcattgtaacagttaagtacatattgaatcagattattgtattctgtgttccgttaatcattattggtttcattgccccttcgattacaaggctgggcaataacgcatcaaaaatgcttggggttgctgttacgcttgcatatgtctcgtcaatcggtgctgcgctgtttgccatgatggcaggctatttcctgattcctcatctgtccattatttctgaggtggaggaacttaagaaactgcctgacatcgtgttccagctggatattccccagatcatgccggtcatgagcgcccttgtgttttccctgcttcttggtctggcggctacatggaccaaggcagaggtaatcacggatgtcctggaggagttccagcagattgttctttccattgtgacaaaagtagtcattccgttgcttcctgtttttattgcatttacattctgcgccttatcatatgaaggcaccattacaaaacagctgcctgtatttttaaaggtggtaatcattgtcatgattggacatttcatctggatgaccctgctttatgtgattgccggtgtctattcaggagcgaatcccctggatgtcatccggaactacgggccggcctacatcactgcggtaggtaccatgtcttccgcagccacccttgcggtcgccctgcgctgtgccaagaagtcacagccgcccctgcgggatgatatggtggatttcggcattccactgtttgccaatatccatctgtgcggatctgtgctgacggaagtattctttgtcatgacggtgaacaagatactctacggtttcatcccctccatggggaccatggttttattctgtgcactcttaggcatatttgccattggagcgcccggtgtgccaggaggcacggtaatggcgtccctggggctgataataggtgtccttggatttgatgagtcgggcacggcattgatgttaactattttcgccctccaggacagcttcgggaccgcatgcaacgtgactggcgacggcgccctgaccatgatccttaccggatttgcgcagaaacatgggattaagagacagaagcttgagagtggtctgtgactggggccggatgggctgccagtggtctataggatgtccaagtaccgttctccttcctgtgtccaaaggccgttttatccacggggattgacagcctgggggaatatgtagtaagatggaaaaaacaggcttctgcgctggcaggtatcccttacagcaaagcagcccgcgcggatattcccaaaacaggataccgcggacagacgggaacagaatatgtgttgactgacctgaagcagggctgagagggaaggcgggtacacttgaacgtaattgtcaggatacgcctgttttggcgtatcctgttttatgttttgggatattttatgttttgggacatgatgcagaacacggacaggaggaacagatacatatgggaatgaatgacacaccttcatcagaacgggtccatatcggattttttggaaggaggaatgccggaaagtccagcgtgctcaatgctgtcacaggccaggacctggccgtggtatccggggtaaagggaaccaccacggatcccgtgcagaaggccatggagcttcttcccctgggcccggtggtgatgattgacacccctggaattgatgatgagggggaactgggcggcctgcgtgtgaaaaagagctaccaggtgcttaataagacggatgtggcggtcctggtggtggaccatggccaaggtatggcggctgaggaccgggcgcttcttaagaggatacaggaaaagcatataccgtgtgtgattgcctgcaataaggcggacctggatgatccggctgaggatccgtgtaatccgggaaagcaggtggaagcaggcggggaaccgcaggaaccatatccggcttcccttcccgtaatcaaggtcagcgcccttaccggacagggcattgatgaactcaaggaatgtctggcggacctggggaaggtacaggagagcgggcgcaggattgtgggggatctgctggagccatcggattttgtcgtcctggtggtgcctattgataaggctgcgcccaagggacgccttatccttccgcagcagcagaccatacgggatatcctggaagcggatgcggcctccattgtactgaaggaggatgaactggcaaaggcgctgccggcgctgggaaagaaaccgaagatggtcatcacggacagccaggtatttggaagggtggcaaaggatacgccggaggatatcctgctgacatcattttccatcctgtttgcaaggtataagggaaatctggcgcccttggtaaagggggcggcggccttaaagggtatcgccgcgggcgataaaatcctgatttcggaggggtgtacccaccacaggcagtgcaatgatatcggaaccgtgaaactgcctggctggattcggcagtataccggcgtggaaccggagttccattttacatccggaacagggtttcccgatgatttaagcgggtacagcctcattgtccactgcggcggatgcatgcttaatgaaagggagatgaagtacaggatggagtgtgcgagggaccagggaatcccaatgaccaattatggcatattgattgcctatacccagggaatcctgaaacgaagcctggggccgttcccggagattgcatcccttctcggatgaaatgaaaataaaatagttttaaatgtataagataaaggtacggaatcaggcggtctgcctgtttccgtgccttttgccgtgttgctgcctgccaccggaaataaaataaaaagaaaatatttttatttatgatttaatattgaaaattattttttgtgtgctatacttgtgataagggaagttaattatagacagaataatatcatatggaaaaggagaagcgatatgaagattcagggtaagagagtctggattgcaggccagttcatggcggcccagatggagattgagaacgggaccattaagcggattgacgggtacggtgcaggtacggcggaccaggattacggggataagaggatcctgcccgggtttattgacatccatacccatggcgcctatgattttgataccaacgacggggagccggagggacttcgcaactggatgaagcggattccggaagagggcgtcacatccatccttccaaccacggtgacccagatgcccgaggtgctcaccaaggcggttgccaatgtggcgcgcgtggccaaagagggatatgagggcgctgagatactgggaatccattttgagggacctttcctggatatggagtataagggggcccagccgccggaggccattgcagttgcttcggtggagcagttcaagaagtaccaggaagctgccggggggatgattaagtatattaccctggcgcctgagcgcgatccggaccatgcgctgacaagatactgttccacccacggcgtggtggtcagcatgggacattcggcggcaacctatgagcaggcactgttaggcattgccaacggcgccacctccatgacccatgtttataacggcatgaccccataccatcaccgcaagccggggctggtggggaccgcgctcagggtcagggatatatatggggagatcatctgcgacggctgtcattcccatctggctgcgctgaataatttctttacagccaagggcagggattactccatcatgatcagcgattccctcagggcgaagcactgccctccgggaggacagtaccagctgggcggccatgacatagagattggcgatgacggcctggcaaggcttaaggggaccgataccattgcgggaagcacgctgaacttaaaccggggccttaagatcctggtggaggacgccatggtgccctttgacacggcagtcaattcctgcaccatcaacccggccagatgccttggggtggatgaccgcaagggcaggattgcagtgggctgtgacgcggacctggtggtgctggaggatgattacagtgtgctccagacctggtgcaagggacgtgcaatgctctaaaatacgggatattttcaataaaatccctgaaaatgcttgcatttaccagaacatgatggtatagtgtatacgataactaatgtagagtactgataaagagtggacgccggtccactctttcgttttgagtagagctcatacaatactgtacggattggaaaggtggtgtagcaatgggaaaaaaggaaaactatgagagcagggtggaacgttacctcctgccgctgatggaagaacatcattttgagcttgtggatgtggaatatgtaaaggaagcaggaacctggtatctgagggcttatattgataaagaaggcggaattgcagtggatgactgtgaggtcatcagcaggaagcttggggattggctggataaagaagatttcattgatgaaagctatatcctggaggtcagttccccgggacttggccgtccccttaaaaaggaaaaggattttatcagaagcatgggcaaggacgtggatgtgcgtctgtaccgccagattgataagcagaaggaatttacaggggccttaagtgcatatgatgggaatactgtgacgctgaccatggaagacggaagccagatggtatttgaaaagccggatattgccctgatacggctggcactggatttctgatactgcattgatagttaattcacatgcccaggcatggataggaggataaacatgaacaaggaactgttagaggcaatggaagtgttggagaaggagaagaacatcgccaaggacacactgattgaagcgattgaaaactcactgctcacagcctgtaagaaccattttggaaaagccgataacgtaaaagtcacggtaaaccccaacacctgtgattttgctgtatatgcagaaaaaaccgtggtggagcaggtggaagacgatataatggaaatcagcctggcggatgccaagatgctgagccccaagtatgatttgggtgatacggtgcagatcccgctggattccaagaaattcggccgtattgcaacacagaatgccaagaatgtgattttacagaaaatccgtgaggaagagcgtaaggttctttacaatgagtattatactaaggaaaaggatgtcatgaccggcatcgtgcagcgttatcttggcaggaacgtaagcatcaaccttggaagggtggatgcaatcctcaatgagagcgagcaggtaaagggcgagaccttccggccgaccgagcgtatcaaggtatatgtgctggaggttaaggacacgccgaagggaccaagggtttccgtgtcaaggacacacccggaccttgttaagcgcctgtttgagtccgaggttgcagaggtgcgtgacggcaccgtggagattaaggccattgccagggaagcaggttccaggacaaagattgcagttaaatccaatgattccaacgtggatccggtaggcgcatgcgtcggccttaacggggcaagggtgaacgccattgtaagtgaactcaggggtgaaaaaatcgatatcattaactgggatgacaatcctgcctatctgattgagaacgcattaagcccggccaaggtgatctgtgtggtggcggacgaggaagagcgcgaggcacaggtaatcgtgccggattaccagctttccctggccattggcaaggaaggacagaacgcaaggctggcagcaaggctgaccggattcaagattgacatcaagagcgagacccaggcaagggagatggggctttttgagcagatggggcttcagtacggagatacccctgcgccaagtttcgaggaagacagctttgaggacgacagcttagaagatacagaaaactatccggaatatgaagagggctaccaggaagacggaaaccagcaggaataggaaattccacgataagacaggttgtggagagattagggatactctgaaaagattaggagtgatgtgagtgagtattaagaaagttccgctcaggcagtgcattggctgccaggagatgaagagcaagaaagaaatgataagagtcataaaaaccgccgaagatgagattatgttagatgccaccggccgtaagaacggaagaggcgcttacctgtgtccatcaatggaatgcttaaagaaggccgtgaagagcaaggggttggaacggtccttcaagatggcgattccgaaagaggtatatgaaactctggaaaaggagatggaagagcttggtaaatagcaaaaaactgttaagcctgataggccttgcaaaaagggccaggaaggtggtcagcggtgaattttcgacggaaaagtctgttaagagcggaaagtcacacatggtaatcgtatcggaggaagcttcggacaacacgaagaaaatgtttaccaatatgtgcactcactataaagtcccaatctatctgtttggtaccaaggatgaactggggcacgccatggggcaggagtttcgagcatccctgtccgtggaagatgcagggttcgcaaagtcaatggcaggactaatgaatataaatggaggtagtttgaatgagagtaagtgaactggcaaatgaactgggtaaaaccagtaaagaaatattggaaatcataaaacaaaaagacaacgcagccgccttgtacgctgcatcgaatgtgacgagggatcaggagaatattgtgcggaattcattaagccctaaaaaagcagctgccccgaaggcagaggcaccaaaaaaggaggcgccaaaagcagaagcgcccaggacagaggctcctaagacggagacccccaagacggaagcaccaaggacagaggcatcgaagccggaagcatccaaggctgcggagtcagccggcaaggcagaaccggccaagaaaaagctgacagccgtgttccgcccgcagaatgcacagcagcagattaagcgtccggtaccgccaaaaccgcagccaaagccacagccgcagcagacacaggctccaaagactgagacgatggctgcagcgccggcaccgcaccaggagccggtacgtccccaggttcaggcccaggcagcggaggctgcgccggttaaagaaacccctgcagcccagacagcgcctgcagcccagaccgcagataaggggaatgcgcctgacagccgcgaggccgcaaggccgcagcatacatcccaggaaggccagggcagccatgagggagggtaccagggaaaccgtccccagggaggttatcagggtaaccgcgagggaggctaccagggcaaccgttctcagggaggctatcagggcaaccgcgagggaggctaccagggcaaccgtccccagggcggaggctatcagggcaaccgtgagggaggctaccagggcaaccgtccccagggcggaggctatcagggcaaccgcgagggaggctaccagggcaaccgtccccagggcggaggctatcagggcaaccgtgagggaggctaccagggcaaccgtccccagggcggaggctatcagggcaaccgcgagggaggctaccagggcaaccgtccccagggcggaggctatcagggcaaccgcgagggaggctaccagggcaaccgtccccagggcggaggctatcagggtaaccgcgagggaggctaccagggtaaccgtccccagggcggaggctatcagggcaaccgcgagggaggctaccagggcaaccgtccccagggcgggggctatcagggcaaccgtcctcagggcgggggctatcagggcaaccgtccccagggcggaggctatcagggtaaccgtccccagggcggaggctacggcggaaggccacagggcggttatgcaggtgacaaggataaggatgcaagggatacaagaggcgtaagaggagacagccgccgtccgggaaccagggacagcaagccatcctttgagacttccatccaggctaaaccaaccagtaaccgtcagaacaagaatgcacatagaaatgaccgttatgacaagagggaccgcacagaggacggaaagaaagtcccgaagacaggcaagggcgcatttatcatgccgcagcctaaaaaggaagaggcaaaggcggatgaagtgaagaccatcacccttccggatgtgctgaccatcagggagctggcggataagatgaagcttcagccttctgtcattgtcaagaaactcttcttaaagggccagatcgtaaccctgaaccaggagattgactatgagcaggcagaggagattgccatggaatttgacgtcctctgtgaaaaggaagtaaaggtagacgtgattgcagaacttcttaaggaggatgaagaaagctccgaggatatgatacccaggtcaccggttgtgtgtgtcatgggccacgttgaccacggcaagacatcccttctggatgcaatccgcgaaaccaatgtgactgcaagggaagccggcggcatcacacagcatatcggtgcatctgtcatcgaaatcaatgaccgcaagatcaccttccttgatacgcccggacatgaggcatttacagcaatgcgtatgaggggtgcccagtcaacggatattgccatcctggtagttgctgcagacgacggcgtgatgcctcagaccgttgaggccatcaaccatgcaaaagcggctggggttgaaatcattgttgccatcaacaagattgataagcccagcgccaatgtggataaagtaaagcaggaactctccgagtatgaactgatttccgaggattggggcggcagcactatatttgtgcctgtttccgcacatactaaggaaggcatcaccgatcttcttgagatggtccttcttacggcagatgtaatggagctgaaagccaatccgaaccgtaagggcagaggccttgtgattgaggcggagctggataagggcaagggcccggttgcaaccgtactggtacagaagggtacgctgcgtgtgggtgataccattgccgccggcgcatgcttcggaaaaatccgtgcaatgatggatgaccggggacgccgtgtgaaggaggccggaccgtccacacctgtggaaatccttggccttaacgatgtgcccaatgcaggcgaagtgtttgtggcaactgaaaatgagaaagaagcaagaagctttgccgagacatttatctcagaaggcaagaataagctgattgaagatacaaaagcaaaactgtccctggatgacctgttcagccagattaaggcaggcaacgtaaaggaactgccgcttatcatcaaggcagacgtacagggttccgtggaggctgtgaagcagagccttaccaagctgtccaacgaggaagtaatggttaaggtcatccatggcggcgtgggtgcaatcaatgaatccgatgtttccctggcatccgccagcaacgcaatcatcattggtttcaacatccgtccggatgcaaccgccaagtccattgccgagagggagaaagtggatgtccgtctttacaaggtcatctatcaggccatcgaggatgtggaggcagccatgaagggtatgctggatcctgtatttgaggaaaaggtaatcggccacgccgttatccgccagaccttcaaggcgtcaggaatcggtaccatcgcaggttcctatgtgctggacggcaagttccagagaggctgcagctgccgcatcaagaggggcacggagcagatattcgagggaccgctggcatccttaaagcgtttcaaggacgatgtgaaggaagtggctgcaggttatgagtgcggtcttgtatttgagaagtttaatgatcttcaggaagatgatgagattgaggcttacatcatggtagaagtacccagataggcctatacagatgatgacaggccccacgccttaggacgtgtttgaaaattcattcccgccatccgtacgtcccacaaagtggaacgcacagctgacggaaagcagttttcaaacactccctggcgctgcgttccaacatgcggcgccgggaagcgctgcggcctgtcacgtcctttcctggaagataagagaggagtttcatgcgtaagaacagcataaagaataccagaatcaatgcggaggtgctcagggaactgagtgagatcatacgcacaggcatcaaggacccgcgtatccatcccatgaccagcgtggtttccgtggaagtgacgccggaccttaaatactgcagggcctatatcagtgtcctgggcaatgaggatgctgcaaaggcaaccattgaaggcttaaagagtgcggaaggatacgtgcgcagggaactggcaagaaggattaacctgcgcaatacaccagaacttaaattcattctggaccagtccattgagtatggggtcaatatgtcaaaactcatcgatgaggtcacaaaggaccttaaagataaagaaggaccggatgaggatggtgaagaggaggagagctgatgacaattcttgaacagatgttagaaggtactggttccgtagcaattttaggacatatacgtcctgatggggactgccttggctctaccttgggactgtataactatctccggcttaattatccggctgtccgcgcagccgtttacctggaggaagcctcaggcaaattcggctatctccggggctttgaggaaatccgccaccaggcggacgaagaggccgtggacctctgtgtctgcctggactgcggtgaccttggaaggctggggggatttgcctgcatcctggaatcagcaggcaaaagcctgtgcctggaccatcatgtgaccaacacacgttttgcggacaccaatctggtggaagacggtgcaagctcaacctgtgaggtcctttatggccagctggacagccagaagattgacaggacggttgctgaatgcctgtacacaggaatcatccacgacacaggcgtgttcaaatactcctgtacctccgccaggaccatggagatagcgggaaagctgatggccaaaggaattgatttcggctccatcattgataacagcttttataaaaaaacatatatccagaaccagatcctgggaagggccctgctggaaagcgttacattttttgacggccgctgcatattcagtgcaatccgccagaacgagatggatttttacggtgtggacagcaaggatatggatgggatcatcgaccagctgcggctgacggagggcgtggaggtggctattttcctttaccagtcaggcgcacaggaattcaaggtcagcatgcgctcacagagccatgtggacgtgagcaggattgctgccttcttcggcggcggcggccatgtaagggcggccggatgcaccatgtcgggaagcatccatgatgtaatcaataacctgtcccagcacatagccaggcagctggatttataagaaggcggcgtggacaggataaaaggactgagactatgtaccatggaatcatgaatgtatataaggagccgggctatacctcccacgatgtggtagcccggctcagaggaattttaaagcagaaaaaagtcggacataccggaaccctggaccctgcggccgagggtgtgcttcccgtatgccttggcatgggcaccaggctctgcgacatgctgacggaccgtaccaagacatatgaggcagtcctgctgctggggatgaccaccgacacacaggatacgacgggacaggtcctggatgaccggcatcaggcggccatgggacttgatgaagtggccgtgacagaagccgtgctgggatttaagggggattatgaccagattcctcccatgtattcagcgcttaaggtggatgggaaaaagctgtatgagcttgccagggcaggaaaggaagtggaacgccaggccagacgggtccagatcctcgaaatccgtgtggacagggtggaacttcccagggtctggatgaccgttacctgttccaaggggacttacataaggaccctgtgccatgacatcggagggaagctgggctgcggcgggtgcatggaacatctgacacgcaccagggtggaccgttttgacataaaagacagcctccggctggatgagatagaaacgataagggatgagggcaggctggatacatgcatccttccggtggaaacagcccttgagggctatgccgtgctgaaggctctgccggaggcggacgccttcctttataatggcaatccctgctttaaaggccagctggatgccggggacggctgccttgacgggctggaggacggcctgagattcaggatgtatgacagcaagggacattttgtgggtgtgtatgagtatcaggacggcaaacactggtggaagccgtggaaaatgttcctggctgccccggagcgtacctgataccatcatgtttgacaccatactgaaggaaaatgaggaatagcaggatgaggtatataacagacaccacggaatttcagatagaggagccaaccattgtcaccctgggtaagtttgacggaaggcacagggggcatcagaagcttttgcgcaccatgaaggaactgaagcaggagctgggctatcccacggccatctttacattcagcatcgcgcccctgacccagatgtccggccagccccagaccgtgataaccaccaacatggagcggcgcgccaatatggaacggatggggattgattatctggtggaatatccgtttaatgaagaaatccgccgcatgatgcctgaggatttcgtgaaggatatactggcgggccgcatgggcgccagggagatcgtggttgggccggactgcagctttggctatcagggcgcgggcaatgcagaactcctgaaacacatggaaaaggagctgggataccatctccatgtgattgaaaaggaaaaagaccatatgcgcgatatcagcagcacctatataagggaagagctggagaagggaaatgtggaaaaggccaatgcgctgctgggggagccttattccatacatgggaaagtagtccacggcaaccacatcggttccagcatcctgggatttcccaccgccaacttagaaccgcctgccatcaagcgccttccccggttcggggtttatgtatccagggtcctggtggacaatgtctattaccgcggggtcaccaacatagggaagaagccgacggtagaggggcagtatcctgtgggggtggagacttatatctttgacctggacagggatatatacggggataccatcgaggtccagctcctggcctttgaccggccggaacagaagtttgcatccctggaagagctgaagcataggattgagatggacaaggagtttgcggcagggtattttgagaggcacccggagattgaggtggcgggacgctaggaagagggcggaaggaaaccgctggaatgaaaataggccaaaagaaaccggtcaaatgaaaacatatggccggaatgaaattaccggtttacatttgtccgcgatcgtgttatactgagtcggcatgagattacgccgatgcccggttaactggttactccagccatttgcctggtttgcggtgagactaattattttaaggaggaactaccatgatttccaaggaaaagaaagcacagatcattgcagagtatggccgtaagcctggtgacacaggttcacctgaggttcagatcgctatcctgacagaaaggattaccgaactgaccgaacatttaaagcagaatcctaaggatcatcattccagaagaggtcttctgatgatggttggacagagaaggggtcttctggattacctgaagaaaacggatctggaaggatatcgtgcattaatcgagaagcttggtatcagaaagtaattctgaagattagggtggaggggactccaccctatatttgcttttcaaacatgggagaagtaatacggtatgatgccttggtatctgcggcattttaccggaatgggcggacaggagagatactccgagaccgctgatgtacccgcaggatggttaggacagataaaggttccggctattgccggtgtccggcgggcagatcagtagtttcggcatcttttttgtctccgtcataacattaattcattatttttttagaaagaaaaggagacaccagtatgtttaaaagttttagtatggacctggccggacgcaagctgaccgtagaaatcggcagggtagcggcccaggccaatggcgcagcattcatgcattatggcgacaccgtggttcttgcaaccgccacagcatcctcaaagccaagggagggcattgatttcttccccctgagcgtggaatatgaggagaagttatattctgtgggcaagattcccggaggtttcaataagagggaaggaaaggcatccgagaacgccgtccttacctgccgtgtcattgaccgtcccatgcgccccctgtttccgaaggattaccgcaatgacgtgaccctggacaacatcgtgatgtccgttgacccggactgcagccctgagctgacagccatgctgggttctgccattgcaaccagcatttccgatatcccgtttgcaggaccatgtgcaaccacacaggtcggccttgtggacggtgagttcgtcatcaaccccacggctgcccagaagcaggtatccgacatggccctgaccgttgcctccaccagggagaaggtcatcatgattgaggctggcgccaacgaagtgccggagcagaagatgattgacgccattttcaaggcacatgaggtgaaccaggaaatcatcagattcatcgacaccattgttgctgagtgcggcaaggaaaagcattcctatgaaagctgtgcggttccggaagaactgtttgcggcaatcagggagattgttcctccggtagagatggagactgctgtatttacagatgacaagcagaccagggagaagaacattgctgaaatcacagcccgtctggaggaggcatttgctgggaacgaagagtggctggcagtcctgggcgaagctgtttaccagtatcagaagaagacggtccgcaagatgatccttaaggaccacaagcgtcctgacggccgtgccattgatgaaatccgccacctggccgcagagattgaccttctgccaagggtacatggttcaggcatgtttacccgcggacagacccagatcctcaacgcctgcacactggcgcctctttctgaagcccagaggattgacggactggatgagaatgaaaccagcaaacgctacatgcaccattataatttcccatccttctcagttggcgagacaaagccaagcaggggaccgggacgccgcgaaatcggccatggcgcgctggcggaacgggcgctgatcccggtgctgccaagcgcggaagaattcccatatgcaatccgtaccgtatccgagacaatggaatccaacggttccacatcccaggcaagtatctgtgcctctaccctgtccctgatggcggccggcgttcccatcaaagagatggtggccggtatctcctgcggcctggtaaccggtgacacggatgacgattatcttgtgctgaccgatatccagggcctggaagatttcttcggcgacatggactttaaggtgggcggtacaaagaacggtatcactgccatccagatggacattaagatccacggtcttacaagacctatcatagaagaggcgataaccaggacaagggaagccaggatgcacatcctggacgacgtgatgaagcctgtcatctccgagccaaggaagcatttaagcccgtatgccccgaagatcaagcagattaccattgatccacagaagattggcgatgtggtaggaaagcagggcaaggtcatcaataagatcattgaagaaaccggtgtcaagattgacattaccgatgatggttccgtgaacgtatgcggtaccgatgaggccatgattgacagggcaatcaccatcattaccggaatcgttacggatatagaagccggcatggtattcgagggcaaggtggtccgtatcatgaacttcggcgcgttcgttgagcttgcccccaacaaggacggaatggtacacatttccaagctgtccgataagcgtgtgggtaaggtagaggatgtggttaacattggcgacgaggttacggtaaaagtaaccgaggttgacaagatgggcaggattaacctgaccatgaggccaagcgacctggctggaaaaaaggaagaggctaaaccagagaactaatctctgataatagcaataaaaaagaggagaaaaagtaactatgaaaaacatgagaacaaagttggcagtgctgcttgcggctgtgatgatggtctgcagcatcgcgctgacaggatgccagagcaagctagtaccggcagaccaggtagtaggagcgctgtatgaactgactgttaaggaaaatgcagttcctgtcaaggacctgcttggctttgcatctgaggatgacgtaagggcttccctgctttctgatgactatgaggatatgtctgacatgttcaagaatgagttttccggcatgggcatcgagtttacggacgatgagatcaaggaaatgtccgacaccatgtccaagcttctgaataagctgagctatacagctgagatccaggaagagggcaaggatgagacaacggttgtccttaaggtaacaggctattccagcgatgacatgaatcagatcatgaccgaccttatgaccgaaatccagaccaatatggatgaggagaccctgacagccctcatgacaggggatgaggaagcaaccatggccctgatgcaggatgtgatcaagcaggtagttgtgaagtttggcgaaatggagccgacaacagaaaccactgacgttaccgttaagtgcgagaagatgaaagtggaagtaagcggcaaggagaaggtttcatggatgccttctgacatggataagtttgtggatgatctggagaacgcatcttttaagtaaatccgtagcaggattccatcagatatgcagtataaccggacagtgcctgggtaaaatcaggcattgtcttttttttgccttcgttatataatgtgttttatgagtcatcaccgggaatgacagagcatttccaggaataaggaaaatataggagactgataagagatgagcagagtaaggacaagatatgcacccagcccaaccggaaggatgcatgtgggaaacttaaggacggcattatatgcttacctgattgcaaaacacgagggcggggatttccttctccgcattgaggatacagaccaggagcgctatgtggaaggcgcggtggagatcatctaccagacacttaaggacaccggattaatccacgacgagggcccggataaggacggcggggtgggtccctatgtccagagtgaacgccaggcatccggcatttacctggaatatgcaaagaagctgattgataagggggaggcatattactgcttctgtacccctgagcgccttgcatcccttaaggagacagtggggggcgaggaaatcatggcatatgacaagcattgcctgggactgtcccaggaggaaatcagggccaacctggaagcgggcctgccctatgtcatccgccagaacaaccccaccacgggaaccaccacctttaacgatgagatttacggcgatatcacggtggataactctgagctggacgacatggtgctgattaagtcggacggataccccacctacaattttgccaatgtggtggacgaccatctgatgggaataacccatgtggtaaggggcaatgaatatctgtcctcctcgcccaagtacaaccggctttaccaggcatttggctgggaggtcccggtttacgtacattgtccgctgattacggacgagcagcaccacaagctgagcaagaggagcggccattcctcctttgaggacctgctggaacagggcttcctgtcagaggcagtggttaactatgtggcccttcttggatggtcgcccgaggacaaccgggaaatcttttccctggaggagatggtgaaggaattcgactatcaccgtatgagcaagtccccggctgtatttgacatgacaaagcttaagtggatgaatggcgagtatataaaggccatggattttgagaagttttacgggatggcggagccgtacatcaggtccgtgatcaaaaaggacctggaccttagaaagatagcagccatggtcaagacaaggattgaagtattccctgacattgcggcacatattgacttctttgaggaactgccggagtacgatgctgccatgtacacccacaagaagatgaagaccaacagtgagacctccctgaaggtgcttacggacctgcttcctgttttggaggcccaggaggattacagcaatgatgccctttacgctgtcctatccaggtatgtggaggagaacggcgtcaagacaggctatgtcatgtggccaatccgcaccgctgtttccggcaggcagatgacaccggccggggccacggaaatcatggaggtacttggcaaagaggagtccctgtcaagactgagggcaggcataaagaaaatcagcgatggcatttaacgatacacagaaaaaagcaatccggcacaggcagggccctatgctggttctggcaggacccggttcaggcaaaaccacagtcattaccaaccgggtccgttatcttacggagcaagccggagttgacccgtcccatatcctggtgataacatttaccagggcggcggccagggagatgaaggagcggtatgaacagatgacccaggcaggatgcggcagggtttccttcggaaccttccattctgtcttttttctgattcttaaacttgcctaccgttaccaggcgtccaatattgtaagggaagagcagaggatacagttcataaaggcacagttaggtgactgcggcctggaggtggaggatgagggggaattcatatcctccatcctcagcgagatcagcatggtcaagggagagatgatggacctggaccattattacgcaaaaaactgcccagaggaagtattcaagcagctgtacagcggatacgaggaacagctgaggcggcacaggcttctggattttgatgatatgctggtcatgtgccaccagctttttacggagaggcaggatatcctttctgcatggcaggacaaataccagtacatactaatcgatgaattccaggatattaaccggatccagtacgagatcgtgaaaatgctggccctgcctgagaacaacctgttcattgtgggtgacgatgaccagtccatataccgcttcaggggcgccaggcccgaactcatgctgggattcgagcgggattacccggatgccagacggcttcttctggacaccaattaccgttccagccgccagatcgtggaggcggccggcagactgattgcccacaacaggacacggtttgaaaaggacataaaggcagccagggggccggggaggcccgtcgatatccgggagtggcctgagcccatggatgaaagcctggcaattgccatggagctgcgggactatgcatccatgggcattgcctaccaggacatggcagtgcttttccggacgaacatggggccaaggcttctcatagaaaagctgatggagtacaatatccctttcagcatgcgcgacacggtgcccaacctttatgaccactggatcgtgaagaacgtgctgtcctacattaaggctgcgtcaggggaccttggcagggccaatatcctttccattatcaaccgtcccaagcgttatgtaagccgggatgccctggagcaccagaccgtggactgggaagcggtgaaatccttttaccaggacaagagctggatgttagacaggattgagcagttggagtatgacctgctcatgcttaaaagcatgtcccctgcagcggccgtgaactatatccgaaaggccgtggattatgattcatatctcagggaatatgcgggggagcgcaggatgaaggtggaggagctgttcgaagtgctggaccagcttcaggagagcgcaggaggatttaagacatatgaggcctggtttgcccacatggacgcctacagggagcagctgttaaaacaggcccagggaggaaacggcccggaacaaggcgtcagcctgatgaccatgcacagctccaagggccttgaattcagggtggtctatatcctggatgccaatgaggggataaccccccatcacaaggccgtgctggaccaggatctggaggaagagcgcaggatgttctacgtggccatgacaagggcaaaggagcggcttcacgtgtactatgtaaaagagcggtaccacaaaaagcaggaagtatcgcggtttgttaaggaggtgggacaatgacgggtcttatccatatatatcacggggacggcaaaggaaaaaccacagcagccgtcggcagcgcggtccgggcagcggggcgcgggaaaaaggtgctgattgcccgtttcctgaaaacagatgactcaggggaagtgatgggcctgggccatgtgcctggcatcaccctgcttccctgcgatgagaatttcggattttcctgggaaatgtcagatgtccagaggaaggcggcgtccctatattacaataacctgttccggatggcatgggaaatggcagcgggccaggatggggctgacgggtttgacatgctggtgctggatgaggtcatcggcgcctgcggcctgggttttgtccatgaagatgtggtggttgagatgcttcgcggcaaacccggcggcctggaggtcatcatgacgggacggggaccgtccgatgagttgatggaatgtgcagactatatcacggaaatggtcatgcgcaggcacccctttgaaaaggggatatctgcacgtgaggggattgaatattagagcgaatattttcttgcatttttccagtgagtctgatagagtgtaagaatagatacacaatttaaagaaagcagattaagagaggaatcataatatggcagatgagaagaacttaaacgaggaagagcaggagatgaccgttaccctcaccctggatgatgacacagaggtggagtgtgtggtactgaccattttcaatgcaggggagcgtgaatatattgcccttctcccggttgaaggcgctgattcagaggaaggggaagtctatctttaccgctacagcgagacagaggacggggaacctgccctggacaacatcgaggacgatgatgagtatgaggctgtggcagatgcctttgacgagcttttagatgcccaggaatatgacgagcttgtaggcgaggatgaattagaagaagaatagaggtccatactgatgatatatcaggctccgggaaggattccggagcttttttgatgttttttgtaattatcatgtccaagctgtgaaacttgtgtgaaaacatggaaatcttccagcttttttgttaaaataagtcctaagtaagtgaaggaggctgagccatggatgcgcttaagatattagtggtagacgatgaggccaggatgaggaagctggtcagggatttcctgaccaataaaggctttaccgtaattgaggcaggagacggcgaggaggcggtggatacctttttcgcgcaaaaggacattgcgctggtactgctggatgtgatgatgcccaagatggacgggtgggaggtgttaaagaccatccgcaaatattcccaggtaccggtcatcatgctgacggccagaagcgaggagcgggacgagcttcagggattctccttgggggtggatgagtatatatccaaacccttcagccccaaaatcctggtggcaagggtggatgcaatcctgcgcaggagcaatgtggtctcaacagagaatatgaacgtgggcgggatctgcattgacaaggccgcccatcaggtaaccatagacggcagggagattgagctgagttacaaggaattcgaactgctcagctattttgtggagaaccagggcattgccctttcccgggagaagatactgaacaatgtgtggaattacgattatttcggggatgcccgcaccattgacacccatgtgaagaagctgcgcagcaagatgggggaaaaaggggattatattaagaccatatggggaatgggctataaattcgaggtgagtgaaggatgaaacattcaatcagggtgagattcaccattatttttatcggccttatggcagcggtgctccttaccctgtgggcggtgaacagctttttcctggaaggtttttataccaatgaaaagctgaaactgctggaagaagcatatgaacagctgaatgaatttgtcattgacaaggctgaggacggcgagaacatcatagacgacctgcaaagcctttactccaaggacggggagcagaccgaggccagccgcatgctccggctgatgagcgagaagtataacatcaccattgccattgtggacagcatgaatgacaacatggtgccctcctaccgggacggaaggttcctggccgacagggtgcaccagtatatacttggaaaaaatgaaccccagacagagactctgatttccgaagacaattataagatacagaaaagctatgacaggcgttcccagggctattacctggaaagctggggtttttttgacgacaacaggaccatcttcatcatgtccatgcccctggccagcatccacgagagcgtggacatctccaataaattcatggcctatgtgggtctggcggccctggtgttcggcagtatccttatgtacggtactacgaaaatggtggtatcccccatccgttccctggcagccctttcggcgcggatgtcggagctggatttcgaggcccgttacacaggaagttcagaggatgaaatcggcgtcctgggcaacagcatgaacacattgtcggaaaaattaaaggaaaccatcggggaactgaagaccgccaacaatgaacttcaaagggatatagaagagaaaatccgcatcgacgagaccaggaaggactttatcgccaatgtatcccacgagctgaagacccccattgcattgatccaggggtatgcggaaggcctgaccgaaggcatggcggaggacccggagagcagggattactactgtgacgtcatcatggacgaggccaataagatgaacaagatggtaaagcagcttcttaccctgacagcccttgaattcggcaatgacatgcctgtgatggaacagtttgatatcgtgaccctgattaaaggcatactctcatccgcaggcatactcctccagcagaaagaggcttccgttgtatttgagcaggaagggccggtgtgggtatgggcagatgaatttaagatagaagaggtcatcaccaattacctgaataatgcaatgaaccatctggaaggggaaaaacggatagaaatccgtctggaaaatagtggaaacgaagtcagggttaccgttttcaacaccggacggcatattccgcaggaggatatcggggatctctggactaagttctataaggtagataaggcaaggaccagggaatacggcggcagcggcattgggctgtccattgtcaaggcaatcatggattcccacaataaggcctgcggcgttgaaaatgtagacggaggagtggaattctggtttaccttggacagcgggatgtaggccgatgaggggacaattacccgcattgtaccgtgcatattgtttcgacctgttgatttatagttgacaaaaaatgtgcatatgctacaattaataggtacctattgtccccttttaaaattagattttggaggtttgttatgaagaagtatcttagcattctgcttgcagcagccgttgttacgggacttgctggctgcggcggatccaacaccggcactacccaggcacctgccacccaggctaccgagtccaaggcacccgatgcacaggccgacacacaggcagatgatgcagaggagaccgaggcatcagacgccggcgatttccacatcggtatcgtcactggttctgtgtcacagtccgaggacgacagacgtggcgccgaggcgttccaggccatgtatggcgaggatatggttaaactggccatctatcctgacaactttacagaggaacttgaaacaaccattcagacgattgttaacctttccgatgatcctcagatgaaggcaatcatcgttaaccagtctgttccgggcacaaccgaagctttccgtaagattaaagaaagccgccccgacatcatctgtatcgcaggtgagggccatgaggacctgccggagattggaagcgctgccgacctggtctgcaacaacgacttcgttgcgcgtggttacctgatcatccgtaccgcccatgagctgggctgcgacacatttgtacatatttccttcccgcgtcatatggcatatgagaccatgagccgccgtgtggctgtcatgaaggaagcctgcaaggaatttggcatggagttcgtccttgagactgccccagacccaacctctgacgtcggcgttgccggtgcacaggcatacatccttgagaaggttccggagtgggttgagaagtacggcaagaacgctgcctacttctgtaccaacgatgcacataccgagccactgcttaagcagctgatggaatacggcggctacttcattgaggctgaccttccttcaccgctgatgggttatcctggcgcactgggtatcgacttaactgctgaggcaggagactttgataagatccttgccaaggttgaatccaccatcgttgaaagaggtggcgctgaccacttcggtacatgggcttattcctatggctacacaacatctgcaggtcttgcacagcacgccctgaacgtccttaatggcgagagcgagctggatgatatcgatgatattgccaaggcttatcaggtattctctccaaaggctgagtggaatggttccaactacaccaacgtggaaaccggcgttaagttagacaacgttttcctggtatatcaggatacctacatcatgggtgatcccggacatttcatgggctctacacagattgaggttccagagaaatacttcaccattaagtaagacgctttataatactaaatttggacaacagtggggggagttcactctcctcctactgtttttaagtggggcataacgatgataaatgacaacactcccttgttggagatgcggaatatcaaaaaggatttctttggaaaccaggtccttacggatatcaacttcacactgaaagcaggtgaggtgctgggccttgtaggcgagaacggagctggcaagagtacgctgatgaagctccttttcggtatggatgtgatcagggaaaccggcggatatggcggagacgtcctgattaacggtgagaaagttaatttctccacaccgtttgatgcgctgaatgcgggaattggcatggttcaccaggaattttccttaatcccgggttttacagccacggaaaatatcctgttaaaccgtgaaccgatgaagaagaatataatttcagaagtttttggagatagattaaataccctggactataaggagatggccggacgttctgcacaggccattgataaaatgggcgtaaagattgatgcggatatggtcatcagtgacatgccggtagggcataagcagttcactgagattgcccgtgagctcagcaaggaacagctgaagctgctgattcttgatgaacctacggccgtattgactgagaaagaggcagaggccctgttagattcaatccgcggcatgtccgccaaaggcattgccgtgattttcatcacccatcgcctgcatgagatcctgaccgtatgcgatacggttgtaatcatgcgtgatggttatgttgtaaaggatgtgccgtccaaggaaacggatgtggcggacattaccaagtggatggtgggcaggaacatccagtccagtgaaagggccgacatcaggattaacccggatgcccggaccatcatgtccatccgcaatctctgggttgacatgcccggtgagaccgtgcgcaacgtcaatctggacatcaaggaaggcgagatccttggaatcggcggtctggctggacagggaaagctgggcattcccaatggagtcatgggactctacgaagcaggcggctcagtggaattcgatggacatgccattccccttaacaatcccaggaagtgcctggattcatcccttgcctttgtttccgaggacagaagggacgtgggcctgctgctggacgaaacacttgagtggaacattgctttttccgccatgcagattcaggacaaattccttaagaactatctgggcggcctgattaaatggagggatgagaaagccatccatgaagtgacccagaagtacatcgacgaactcatgattaaatgtaccagttccctgcaaaaggccaaggaactttccggcggtaaccagcagaaggtgtgcctggccaaggcatttgcccttgaacctaaattcctgtttgtttccgaacccacgagaggtatcgacgtcggtgcgaaatcgctggttctggacgccctgaagaagttcaacaaggaacacggtgtcacggtggtcatgatttcgtccgagcttgaagaactgcggacaacctgtgaccgcattgcgattgtttcgggcggtaagattgctggaatcctgccggcgaccgaatcttcagaagaattcggcctgctcatggtcagccaggttaaataagggggagacagcatgggaaaaaatgaaaatatgacaacaactcttggctataagtcaaaaatcaaggaattggtgaatgattttggcctgccaagattaatcatcgccgggttccttctggcgctcttcattctggcaccgctggttggggcagaccttcctacccagataaccaacacgattaaccgtttcagctggaatgcagtactggttctggccatggtgcccatggtgcattcaggctgcggccttaacttcggccttccgcttggcattatctcaggccttctgggcgcgaccatgtccatccagttcggctttaccgggcctatgagctttgttatggctattttaattgcaacgcccttcgcactggtgtttggctgtggctatggctggctgttaaacaagattaaaggcggggagatgatgattgccacatatgtgggcttttcgtcagtttcctttatgtgtatgatgtggcttttgctgccctacagcagcccgaccatggtctggggcctgtcaggcaagggactccgtaccaccatctcactggagggcttttatgacaaggtcctggctaacttcctgcagattaatatcgggcatttttccataccggtgggcagccttctgttcttcgccgtgcttgccttcctgatgtgggcgtttcttcacacaaagaccggcactgccatgaccgcggtagggtcaaacccggattttgcaagggcatccggtatcaacattgacaagatgagaatgctttcggttatcatgtccacttggcttgccgcggttggcatcctgatgtatgagcagggattcggttttatccagctctacacggcgccgttttttatggcgctcccggcggtgtccgctatcctgattggaggcgcttcggtcaataaggcgtccattaccaatgtaatcatcggtacgttcctgttccagggaatggtaaccatgaccccaacggtaatgaattccatgattcatatggatatgagcgaggttatccgtatcgttgtttccaacggtatgattctctatgctttgaccagaaagacggaggcatcaaaatgaaagaaaagaataaaaaaattgaaggcaaccgcatactggaatttgccgggaataattctgtgccaatcatgtttgtcatcatctgtgccgtctgcattccggtgtccggcttttcgccgggttatctgctgaacgaaatcatgaccagactgggcaggaacgcgtttttgattcttagcctcttgattccaatcatggctggcatgggcttgaatttcggtatgacactgggggccatggctgggcagattggcctgatttttgcggccgactggcagatatggggaatcccgggaatggttcttgcgatgattatctcaattccgatttccatcctgctaggcatcttctgtggaaagatgcttaatatggcaaagggcagggagatgatcaccagctatatcatcagctttttcatgaatggtatctatcagatggtagtgctgtacatgatggggccggtcatcccgattatccattcttccatcaaactgcccagaggctatggagtccgcaatacggtcagcctcctgcacatgaggcagtccttggataacctgttggcgattcacatcggcggagttaagattccggttctgactttgattgtcatcggtctgatgtgcctgttcattgtgtggttcaggaagacgaaactgggccaagatatgcgcgctgtgggccaggatatggacgtggccggagacgccggcatcaaggtggagcggaccagaatcattgccatcgtgatgtcaacggtctgcgccggcatcggtatggtcatttatctgcagaatatgggcaatatttctacctacagttcacacacgcagattggtatgttctgtatcgcggctctgctggtcggcggggcttctgttgacagggcatctatcggcaacgtgttcctgggcgtcatcctgttccatctgatgttcatcgtggcaccgtcgacgggtgcgaagattacaggcgactccatgattggagagtatttccgtgtgttcatctcctatggcgtcatcacgcttgctcttatcatgtatgagactaaaaagcggagagcaaaaagcaaagccggtcaggtacttaagcttgcacagggtgaggaggaagaaaattgaagatgaaacgaacctttctgttccgggcgggagcaattctgctgctgctcatcatagcaggcatcatgatggtcattggccgtggccataccgtgtatatcgacaataagtcccttgattacaatggacagacttattccactccttataaggtggtggtgttcgtggacggcgaacaggtagcgaaactccgtgataaagaaagaggtatggcaacctgtatcggtcagaagttcaacatgactcttgagattacacaggaaaaaggcggcagcgaggaaaccgttaacgtggcgctgaacctgccgcatcacatggatggcattgccattaacctgccggcgtatctggcgggacttcccgaagatgcatatctttccgaattccagattgcggtggaagaaacggaagagccgagcgaggaagcgcctatagacggcgcggtggatgagtttgatttaggagatatttaaatccagtaccgttaattttatgatgcagccatggatggaaacatggctgcatttttatatagcaagcgttgcagggacgaaaagcggggggtaccccgtggatgcaggtgtggatgatatagaaaacgtgtatgggatatttgataagcatgttcaggacatgcgggaagcataagtgttatatgaatagaagaggggcatgaggcttacgtcgaatggaagaaatgcgaattgttaagataattaaaaaaagttaaaaaagttgttgacaattgtcgaagcatctggtaagatatctcttgcgctgcggtgagagccacaacgcaggaacacagaaaagaaaaaagttaaaaaagttgttgacaaacacaagcaactgtgataagatataaaagttgctgctgaacaagccgacaacacagagaaccttgataattgaagattgaacagtatgtaaaaccctgaaaattctaaaaacagaaggcctggtttgggcctttggatttgagaaaattcagaacaaaaccaagtaatgaaggttaaagataactagccaagctaagtagtctgaaaccaaggaacactctttatgggggtgtccgcaaacgtaacggtcctgagagacggaccgcaactaatgcggactaagttttcacgtaacactcgtggaagacctcgtgtaagtgaaaaacttataatttgagagtttgatcctggctcaggatgaacgctggcggcgtgcctaacacatgcaagtcgaacgaagcatcccataggaagttttcggatggaatatgggatgactgagtggcggacgggtgagtaacgcgtggataacctgcctcacactgggggataacagttagaaatggctgctaataccgcataagcgcacagtaccgcatggtacggtgtgaaaaacccaggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaagcccggggctcaaccccgggactgctttggaaactgtgtggctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatgctaggtgtcggggggcaaagcccctcggtgccgccgctaacgcaataagcattccacctggggagtacgttcgcaagaatgaaactcaaaggaattgacggggacccgcacaagcggtggagcatgtggtttaattcgaagcaacgcgaagaaccttaccaagtcttgacatccccctgaccggacagtaacgtgtcccttccttcgggacaggggagacaggtggtgcatggttgtcgtcagctcgtgtcgtgagatgttgggttaagtcccgcaacgagcgcaacccttatccttagtagccagcacctcgggtgggcactctagggagactgccagggataacctggaggaaggtggggatgacgtcaaatcatcatgccccttatgatttgggctacacacgtgctacaatggcgtaaacaaagggaagcggccctgcgaaggtgagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttctaaggaagaagaagtaagggttttatatactgtccagttttctgattatcaagcaattgaataaggaagacgaaagatttctggtgccgatgcgcttaggggacacacccgttcccatcccgaacacgatggttaagacctaagcggccgatggtactatgctggagacggcatgggagagcaggtgggtgccagattaccgtgggggtgtagctcagttgggagagcacctgccttgcaagcagggggtcaagagttcgaatctctccatctccattcgggattgtcctaacaggacggtccccatacgtaccttgaaaaccgcatattgaaaaaatgaattgagtatcctaagaaattaggataaacaagacatccgaggccatacaagcgattgtatggaaagaaacaaacttgtgaacgcgaaagcgttcaagaagaacctagaaccaaagggcccaacgctatgggccttgacggaaacccgcacccgcaggtggaagtcatcttggttaagctgataagagcgcagggtggatgccttggcactaagagccgatgaaagacgtgataagctgcgaaaagcttcggggaggagcaaatatcctttgatccggaggtatctgaatggggaaacctggctgagcaaccctcagtcgtcgtatggtgaatacatagccatacgtcgggaacccggtgaactgaaacatctaagtaaccggaggaagagaaagaaacatcgattcccagagtagcggcgagcgaaatgggaggagcccaaaccagcgtgcgtgcatgctggggttatggaccgcataagtgagccgatctgttaatggaactgcctgggaaggcaggccacagagggtgagagccccgtacatgaaaacagtaggcagcggcggtatccagagtaccacgagacacgagaaaccttgtgggaagtcggagggaccaccctccaaggctaaatactacttagtgaccgatagcgcatagtactgtgaaggaaaggtgaaaaggaccccgggaggggagtgaaagagaacctgaaaccctgtgtttacaagctgtgggagcacgttaaggtgcgaccgcgtactttttgtagaacggtccggcgagttgccggtactggcaaggttaagcacttaaggtgcggagccgaagggagaccgagtcttaaatgggcgtcaagtcagtacaggcagacccgaaaccgggtgacctatccatgtccaggttgaagcggaagtaaaattccgtggaggaccggatccacatccgttgaaaagggtgggaatgaggtgtggataggggagaaattccaatcgaacccggagatagctggttctcctcgaaatagctttagggctagcctcgtatcaagtttagcggaggtagagcactgaattcctaagggggcgtcaaagcttaccaagggatatcaaactccgaatgccgcataaatgatgtacgggagtcagactgcacgagataagttgggtagtcaaaagggaaagagcccagacctacagctaaggtcccaaagtgtgtgttaagtggaaaaggatgtgggatttcaaagacaactaggatgttggctcagaagcagccacacattcaaagagtgcgtaatagctcactagtcgagaggtcctgcgccgaaaatgtccggggctgaaacacaacaccgaagcttaggaatgtacgtgagtacattggtagaggagcattcttaaaggggtgaagcagtaccgatgaggagctgtggacctttaagaagagagaatgccggaatgagtagcgagatggaggtgggaatcctccaggccgaatatccaaggtttccagagtaaagctgatctgctctgggtaagtcggggcctaaggcgaggctgggaggcgtagccgatggacaacaggttgagattcctgtaccatgcatcatcagaactgtggggacacagaaggacaacacatcccgggaatgggaataccggggcaagcgtagtaggggttaagctggcaaatccgcttaacaacccgaagacgtgacgcggaacgaactgaagtagtgaagtgtgtgattccggctgtcaagaaaagccgctatcgtgtgatgcatgcccgtaccgtaaaccgacacaggtggatgaggagagaatcctaaggccggcgggagaagcattgttaaggaactcggcaaaatgaccccgtaacttcgggagaaggggtgccacagagatgtggccgcagagaataggctcaagcaactgtttagcaaaaacacaggtctatgcaaaaccgtaaggtgaggtatatgggctgacgcctgcccggtgctggaaggttaagaggagaggttagggaaaccgaagctttgaatttaagccccagtaaacggcggccgtaactataacggtcctaaggtagcgaaattccttgtcgggtaagttccgacccgcacgaaaggcgtaatgatttgagcgctgtctcaacaatgcacccggtgaaattgaaataccagtgaagatgctggttacctgcgccaggacggaaagaccccatggagctttactccagcttgatactgggatccggtgctgcatgtacaggataggtgggaggctaagagatatggacgccagtctgtatggagccattgttgggataccacccttgcggtactgggtttctaacctgcgcccatgacctgggcgggggacaatgtcaggtggggagtttgactggggcggtcgcctccgaaagggtatcggaggcgctcaaaggttccctcaggatggttggaaaccatccaaagagtgcaaaggcataagggggcttgactgcgagactgacgggtcgagcaggtacgaaagtaggacttagtgatccggtggtatgaaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcgtaggagatctgagaggagctgtccttagtacgagaggaccgggatggacagaccgctggtgtacctgttggcctaccagggccatggcagggtagccaagtctggacgggataaacgctgaaggcatctaagcgtgaagcccccctcaagatgagatttcccatgcgaaagcagtaagaccccttgaagacgacgaggtggataggttagaggtggaagtgcagcaatgtacggagctgactaatactaatcggtcgagggcttaaccagaaggttcagggagaaacaggaagtttgtcagttcggttttcaatatgtggttttgagggtacgttaatgtaattctcaattgaatcagttttaaatgcgcgagtggctcagtggtggagtatcgccttgccaaggcgagggtcgcgggttcgaatcccgtctcgcgcttttttgatggctggaatttccttgattttatagggatttcagccttttatgtgctccaaaatgctgtagacagttgtatacacctctaatctggtcaaagggagaaatttccagattggagaaggtatttcccccttcttggaattatggtaaaataaaaatggccataaacagacggtattgactgcttccgtcagctgaatccatgaggtgacaatatgaagagattggagatttccttttttgatacagatgaaaaagtcatagtcgatgaaaatgcactggttatagctcttgataataaaactacaccggatggtctgacaaggtgtattatcttggaagccgacgggaacctgccaaaaaaattattggaacgtcccttgatgttttatatttatgatgatgtaccaatcttaaaattatataggagtgcatacatttcttcttatcaatggaaagcttaaagcgtatagttaggttgggtaaatactttaaataaggccgtcctgggcgccggcgcatgattttgatatcagcatgacagcaggcaggaagtttcctttgggcagcttcctgtcttgtcatatctggaaaattgtactataataggcgaaatggactgccctgtcccaatgaggcgccagccagatgcagaggaacattaccagattcacattaccagatgcacagtaacaaaagggctggctgccaaagcagggaaaagtcacagaacaggcaggtatagagggatgacaggattagggacaattgtaaatatcggggcaatcctggccggatgtatggttgggatgctgctgaaggggggacttccaaaacgccttcaggataccatctccagcgcggtggggctgtgcgtggtgtttgtggggataacaggaggaataaagggcctgatgaccatgtccggcagcggctttgagacaagggatacccttgtgactgttgtgtgcatggtggcgggagcggcgctgggagagtggattaatattgaatataaactggagcagttaggcggctggtgtaagtcccggattccggggggccagaagtcagggacttttacggaggcatttgtcagctcatccctgctgttctgcgtgggcgccatggcaatcgtgggctcactggaggacggactcagtcataattacagtacactgtttacaaaagcagtgatggatggggtgctgtccattgtatttaccgccaccctggggattggaaccgtcttctccatctttccggtagggatataccagggcggtatgactgcgctggccggactggtgaagccgtatctcacggacctgatgattgtcaggatgtcctgtattggttccatcctgattttcgggctggggctgaatcttgtcctaggaagtaaaattaaaatcggcaacctgcttccggcggtgttcctgccgttgattgcatgtgcccttggtttttaggaatatacggatataaaagggaggatgatggaaatggaatttgcaaagagaatggaccgctttggggaggggatcttttcaaagctggctgagattaagagacagaagcttaagcggggggaggaggtcattgaccttagtatcggcgcacccaatataccgcccgcggcccacattacagaggcgctctgtaaggctgcggccgaccctaagaattatgtgtatgccatcagcgacaggaatgaactgctggatgctgtttccggctggtatatgaagcgctatggggtcgccctggaccctgacagggaaatctgttccctgctgggctcacaggagggccttgcccacattgcgctgaccatggtggacgaaggggatatagtgctggttcctgacccctgctaccctgtgtttggggatggtccccagatagcaggcgctaatctgtactacatgccccagaaaaaggaaaatggatatataatccgcctggacgggatacctgaggacgtggcagaaaaggcaaagcttatggtggtctcttatccgaacaacccgaccactgccatggcgcctgattcattttatgaagaattgattgcatttgcgtcaaaacatgatatcatcgtgcttcacgacaatgcatacagtgaccttgtgtttgacggaaggacctgcggcagtttcctgcgtttcccaggtgccagggaggttggggtggagtttaattccctgtccaagacatacggcctggcaggtgccaggattggcttctgtctgggcaatgaagaggtggtgtccagaatcaagctgttgaagtccaatatggattatggcatgttccttcctatccaggcagcagccattgcagccataacaggcgaccagtcctgtgtacataccacgatgaaagcctatgagacgcgccgtaatatcatgtgcgacggatttacggggattggatggaagatggagcggcccgcagcaaccatgtttgtgtgggcaggaattccggagaagtttaagtcctcagaggagtttgtgatggcgctggtggaaaaggccggggtcatggtaactcccggcagcgcctttggcccgtccggcgaaggttatgtgcgcctggcccttgtacaggatgaggaaatgctgaataaagccatccgggccgtggatgccagcggtatccttaaataaacgtgatagtgaaggctgaaggaaaatgcagatgggtgcatgggagcagccggaaggaggacgcaggtgggtgcatgagtgagtccggaagaaaaggagtaatgacaggatgaaggacagaaagacaacgggcctgcatggtagcgggaagacaatggacctgccggggcgcggtaaaacatcgggcctgccggaacacaggacagcggcaggtccgggacagcgggtggcccttatcctgctgattgtatatatatgctttatatatggcaattcccttacgcctgcccatatttcctccagggagagcgggttcctgctcatgaagcttcatgactttttggaaatgattggttttgacagcagatggcttactgaacatattgtgaggaaaagcgcgcattttatagagtatacaggtctgggcatccttcttgccttttactgcaggacatggatgcccaaaggaatcaggaagcccaggctggcggcagagctggcattccttgtgccctttgtggatgaaaccatccagctgtttgtggatggacggtccggacaggtggatgatgtttggctggatctgtgcggagtgatgtgcggtctggcgttgacaacggtactggctttcatgagaaaaacagataggggaaaattaaaatgaattatatcatttggctgtcctatgacgggacgcgttatgacggatggcagaagcagggcaatacggaaaagaccatccagggaaaactggaacgcgtcctggagaagctggatggggaaccggtggaggtacggggcagcggaaggacggacgcaggcgtccatgcccgtggccaggtggctgatttccagttaaagggaaagagggcgccggaagaggtaatggagtacctgaacaggtatcttcccgaggacatagctgtgtggaggatccaaacagcgccggagcggttccacagccgcttaaatgctgtgaggaagacctaccgctaccagattgaactgggacctaaaaaggatgtgttccggcgcagctattattatggtctgggacaggaactggacgtggcttccatggaaagggccgcagcatacctgacaggtaccagggattttaagagcttctgcggcaataaaaagatgaaaaaatccacggtacggaccctggagtccatacgctttgaacgtctggaagataccaggcttcatatatcatttacgggaaacgggtttttacagcagatggtgcgtatcctgaccggaaccctgattgaagtgggacagggcaggagaaagccggaggacatgaggtccattctggaggcgctggaccggcaggccgccgggtttacagccccgccagaggggctgtttcttgaaaaggtagaatatggggaactgatatgactgattttttggtaaaacattttgttaagaaccatgaacaggtggagaaagacgaggtcaggacagagtacggcacccttgcaagcggggtgggaatctgctgtaaccttctgctgtttgcagccaagctgatcattggaatactggtgaacagtatctctgtcatggcagatgcatttaataacctgtccgatgcagcctcttccattattggctttatcggcgttaagatggcggaaaagccggctgatgatgaccatccattcggacatggaaggattgaatatatttcggctttcattgtggccttcctggtcatccaggtgggtttttcactgtttaagtcatcagtgggaaagataatccaccctgaggatatgacctttagatggatttccattgtcatcctcctgctttccgtgggagtgaagctgtggctgtccatgtttaataagaagctggggaaaagaatcaattccaaggtcatgatggcaacctcggcagatgcaatgggggatgtggcagccacatcggccacgattttttccattgcagtttatggcatcgccggtttgaatgtggatggtatcgtgggaatcatcgtatccgtggtagtcatgattgccggtgtgaatattgcaaaggataccctggcgcccctgataggagagggcattgacccggagttttacgaggaaatcagtaattttgtggagagttttgacggtatagtgggaacccatgatctgattgtacataattatgggccaaccagaagcatggcatccatccatgcggaggttcccaatgactgcgatgtggagttcagccatgagattattgaccgcattgaacgggaggctctgcggcggttccgtcttctgctcgtaatccatatggatccggtggagacacacaatgaactggttgttaaatttaaagatatggtggccgatgttctggaaaatattgacagccgcctggaattccatgatttcaggatggtggacggacaggcccggatcaacctgatttttgatttagtagttccctgggaatataaacagtctgcccagggtaaactgaaagcaaggattagcgatgaggtcaaaaagcgggatgggcgatgcgagtgcgtcattaccgtggagaacagtttcatgtcgggaaatagagagtaggctaatccccaaagggggaagggcagatgacacaggaagagatgatacaggcaatggcagagggggacagggaagctttccgccagttttatcaggaaaccgcccgcccggtgtacagctttatcctgtcgctgacaaaaagcccctatgaggcagaggacctgatgcaggaaacgtatctttgcgtatggaccaaggccggctcctacgtcccgttgggaaagcctctggcatgggtttttaccattgccaggaatctctgctacatgaggttcagggagcagaaaatggtaagcaatgttgcccttgaagacctggaaggaaaggaggaaggggcgtattgtgaatccctggaacaggcagcggacaggaaggtgctcttagatgccctcggtaagatcagcgaggaggagcggcagatcgtgctccttcatacggcggccggaatgaagcacagggaagtggcacagaccttggaaatgcctctggccacagtcctgtccaagtacaaccgctccatgaaaaagcttcagaatatcctgaaatatccgggcgcctgaatggctgtccggggagagattcaaaaagtctttggaaaaatagatggactttgggaaaatactttggaaaaatattcaaaaaggtacttgacgaaaattaaactatgatatataataactttcgttgtgttattgggctatcgccaaatggtaaggcaacggactctgactccgtcatttcaaggttcgaatccttgtagcccagttattgaggaaaccgggaatccagttcatggatttccggttttttatgatgcgccgctggcatattgccttgcgggattatttggtttatggtatcctatcctgtaagcgatgttttgccagagcgccagatatctgggaaaaggggtttgaatgtctagtaaaaagaaaaatatattgaacgctgtatttttgctgattgtattcttcctgaccatttacagtgtgtttaagggagaagatttaagcgatatagcggataccataaccgaggcgtcaccggtgttcctgatcctgggcgtgtcctgtgtggtattcttcatatgggcggagtcggccatcctccattatctctttggaacgctgcatgtaaaggcaaagcggcggacctgcttcatgtattcggccattggctttttcttcagctgtatcacgccctcggcaggaggagggcagccggcccaggtgtactatatgaggaagaatatgataccggtgcccgtggcaacggtggtgctgatggttgtgaccattacatataagtccgtgctggtcattgcaggatgtctcctggctgtgtttgggagggggatgctggaccgttacctgtatgaggtcatgcctgtgttttatctgggtcttaccctgaacgtggtgttctgccttgccatgctgatcctggcgttccatacgtccctggcaaagaatattgccatgaagctgctgggattcctggtgaggctgcatatactgaaggataagccgtccaggacggagcgtctcaccctgaccatggaccactacaatgaaaccgccttgtacctgcgacagcacaaggaagtactggtgcgggtgacgctccttactttctgccagaggattgccctgttttccgtcacatattttgtctataaagcctttgggctaagagggacccatgcagcaacccttatccttttgcagtcaaccatatccatatcagcagacatgcttccccttcctgggggcatgggaatcagtgagcatctgttcctgaccatatttgaccctattttttatggggacctgctgcttccggccatggtactttcacggggaattgcttattatgtgcagctgctgttcagtgctgccgtgacattaggcgcccatatcctggtcgacagacggcaaaaaggaacctaaaaaatttttaggtaatctaaaaatgattgtgcatattgctgaattttcatcttcaagttggtcagtatgcccattgtagaggataatagaacgtgctatgattaaatatataaaatattttaggtacactaaaaaaattagaggtgttagcacgtgaaaaattcagatatgttcaagcgttatggaatgtttattgcaggagtcatattcagtgcattgggaataagcctgattacaaaagcagggctgggaacgtcgccgattaccagccttgcttttgtgttgacctttattttcccgcataccctgggtacctttaccatgatggtcaattctgttatgtttatcatccaggtaatcctgctggggaaagcgtttcagaaaatccagctgcttcagcttcctgcggcgcttttattttccgtctgtattgacggctggctcagcatcctgagttattggcagacaggcggctatgtgggacaggtgctgatgctgctgctaggctgcgtcttcctggggcttgggattgcacttgaggtcatacccaatgtcctcatccttcccggtgaaggactggtacgtgtgattgcagggcttaccggatggaggttcggccgtgtgaagaccgggtttgatatgagtattgtggccagtgcggtggtggtttccgtcctggtaaagggacaggtgctgggcatccgggagggaaccgtgattgcggccctgattgtggggagcatatcccatttctttatcgagaaggtttctgcggcccttgggggctggattccgtcctatacagaggcaggagacgcatgttcataagggttgtaggagtacatccatctgcggtttgagcggcaggtgggtgtttttatgtgggtttatccagtgatgcgttataaaaagggtattacataatagggtagtaatcagatgaataattgataaattagagaaaaatacttgacaaattagtggaacatgttaaaataaacattagttacgcgcgtaactaatgccctgcttttatatttgaaagatattttttttcttgctaagttacacgcgtaactgaggagataggagaaggaggaatggagattggaacaaaataggtgcccgaggattggaatcataggctgtggacagattgcgaaaatccgtcatgtgccggaacttgcgggctgcaaggatgcagaacttgctggtttttacgattatgtgccggaacatgccaggtccctggccagccagtatgggggaaaggtctatgaccgatatgaagagatgctggaggatgaaaccgttgacggggttgtaatctgtacttccaatgacagtcatggaaggatttccgtagaagcccttaagagggataggtatgttttatgtgaaaaacccatgtgtatgagtcttgaggaagctggacaggtgctggaggcggagcgggagagtaaggcattctacatggcagcccataaccagcgttttactctggcccatagaaaggcaaaggagattttaatgggcggccagatgggaaaaatcattgccttcaggtgcaccctggcgcatgatggaccagaacgcttcagcattaaccggtccacatccacctggtacttaaacaaacggaattcaggctttgggtgtatcaccgatttggggattcataagtgcgatgtacttagttatcttttgggagagccttttataagggttggggccatcggtggtaccagggacaagtgtgatgcagagggaaggcttgtggatgtatatgacaatgcagtctgtgtcctggagagcagatcaggtgttatgggaacccttaacctgtcttattccaattatgggcccatggaaaacgggacggtttattattgccagaaaggggtgctccatgtccagtacagtcaggactgtgcactggaggtaatcatggattccggtgagaaaatacggtacataagccaggagaatccgtcttcacaagtggtcggtacttttgtaaaagcaatacgggaccatggccagtcacctgtgtctgcaaaggagtcctatgaggcaatgcgtgtggtatctgcaatagaggagtctgccaggacaggagcttttatcaatttataataggatatgtgaagtcagatagcctggaggatataggattatcctttcctttttctgaaactggtaatataataacaccagaataaatggaagggaaagaacgagtatgtcaaagcgaaaggaagttgcagcagcagcaggtgtgtctgaggctacagtatcccatgtaataaatggaacaaagtatgtgagcccggaacttgccgcacgggtaaggaaagccatcgaagaaaagggctattatttaaaccaggcagccaggtgcctggctacgaacagaagcggacatctggcgctggtggtgaataacttaaagaacccacgttacgcggaagtggcagaagccatgcaggaggaagccaggaaacggggatacattgtatctgtcatagatatcaatatttttaactttaatgaagatgctatttttgacctgatagccagaaatgtagacggattattcctggcaacctacattgatagcatggaaccggctatacgcagggcttgtgaaagcggtatccgtgtagtctcaggctgtccggaatttggcagggttctgaagattgactatgaggattccattggaaatctggtccggtatctggcaggggctggccataggcggattgcttttcttagcggctattcactaaaagagtcatctcatgaaaaatatgctaatttctgccaggccatggacgctaatggcctgaagatactgccggaacttatgattgatggtcagatgccttatatcgccgacctggatactggattccaggccatgaatcagcttttagaaagaggtacggaggtagatgcggtcttcgctgtcaacgacctggtagctattggggcgatgaaggctttgcggcagagggggttccgtgtcccggaagatatttccgtggcgggatgtgatgatattccatttgcttcctatgttgagccggtattggccaccatcagtgtccccaaagcggagatgggaaaacttgcggcagagatgctgtgcgatatcctgaataacaggccctgtgaggaccattatctgaaaactacatttaaagcaggagcatcaatcggatatgtgtaaagcgtaaaagatgctgggatattgtattgccagacatgttccggatgtggttatcagggaaaccatataagaaaggaaacttaaagatgacgcataaagaacgtttgatggcagtaaaagaaggacggaagacagacagaccagcatttgtggcctgggggccccatatgaacctggtagacagaaatgtaaaggattttaccgaggcaaccattgcatatcagaatacatatcagtttgattttataaaactgatgcctaacggtatgtattttacagaagatttcggacagatgttaaagccagccgcccatatttatgatgatacctggatgaacgtacaggcaagtgcagttaatgatccgcatcagtggtctaagattaaggtgccggacctgaaaaaaggcgccctggcaagggaagttgaggtctgtaaacgggtgaatgattattatcagggagatgtgccggtgttagccactgttttcagcccgttcatatggatgggggagatgacggggggatttttccatccggaggtaatcctttcacattttgaatattcgggcagctatgcacgggcagccctcgaggtgatttctgaaaccaatgagcggcttatggaagcatttgttgatgcgggggctgctggttttttcctggggtatcagtgtggaatggctaagctgatgggcagggatatgtttgacgagtgcgcaaggaaatatgatgtaaggaatattaatgcaattaaagacaggacatggtttaacatggctcatatctgccatggggatgccggcaccagccaatggtttttggattatccggtagatgcatttaactgggcggaccaggaacaaggccagttgaccattggcgaaatgcgtcagaaaacagaacgggtccttgtgggcgggctggatcatgccaatggacatggttataaggaacttgaaggcagatataaacctagctctgattttgctgggaatgacagggatgagataaaagcccatattaaaaagaaggtgaaagaagccttaaagtcgggtggattaaaaacagtcatatccggaggatgcggctggtctgaaggttcccttcccagatttcctctttggagggaagtgatggaggaaatcggggaggaaggctgggatgaagcataagatattgctccttggaataggattttggggccggcgatggctggaactgattttaaagtcaggacgctgccagctggcgggtgcagcaggcagtgaggacgaaatgcaggaagtatgtatcagttatggaatcaatcctgcaatcacgtttactgatttcaggaaagccattgcccggacagcggcagacattgcagtggtagtgcttccgggtgtactgcattttgaagcggacaggctggcgttggaaaaaggcatgaatctgattacagagaagccgctggcaatgaatatggaggaggctatggagttactgcgcctgaaagccagatatccactccagcggttcatggcttcgcagaattaccgatggagaccctgcaaccaggccatgaaacgggccattgaccatggtatgattggcaggatggagtccatacttttggaattccgccagcaggaggatttacagggatacagggcgggattagaaatgcctcttctgcaggatgtgtccatccatcattttgacctgatacggttttttaccggtgcggattgtaaggaaacgtattgctgcgttagcagaccgtcctggtccctatatcaaggaaagccggatacacaggcaatcttccggatgagcaacggtgttacggtcacatatagcggaagctgggcagccaggggaaaggaaacttcctgggacgggaatttcacgattacaggggacaagggatgcctgaccctggatgcagatggaagggtgtatttttataaacatgaaaaggcagatgcggttgtacttgatactgccagccagcagggagaagaagtcggtctgcctgaaatgaagtatgcagaaatggaatacggtttccatatgttcctggacagtgttgagcagggggatgttccggaaaccacccttgaggataatgtgaagagctttgtcatggtcatggcctgccttgaatctgcaaagcgcgcaacggtagtggattgtgatgagatgctgcggcaatatgcacggtgaaaggaaaaagatgattatgtcacaggaaaaatatacgattagaatgcgtctgtcggcttggtttggacttgcagctttggtttttggggctttttgtggaggcgcaatggcttccggcgcttatgccaccagctattttgccagatatggaggcggccatatgcttatcttcatccttatttttatgaccatcatggcagtctgctgtattctgggtatcaatgtaatcagggcttataaagtaacggattataatggattctatcttgcactatacggtcttcatagggatggttccagtcccggacttaggaagattgtcacgctgttttttgatttttataccatattgtcaggtattgccgcctgtgcaggcgcaatggcccttttcggcgcacttgccaattcaaccactggaatgcctgtacaggcaggttcactgattgcagcttttgtatttgccatccttagcgtttatggcagtgcattcctgcgtaaattcaacactgtgatgaccctggctttgacaggcagccttttggcggtcctggctgctgtgtgtgccatgcggggagatgtgcttattggcctgctgggagattttaagacaggggtggactggagcggggcttctcttgccacgggttacaccatgctcatttcatactgttttaatgtgggttcatggggagctacccttagcagttattcggaaaaaatccgggaccagaaggatgcggtcggttctggtattatgattgcaatttttgtcagcgcactgttttttgtcacatcctgtatcgtgcttccgtatctgccggaacaactgaactccaccccgattctgaacatctgccagaattatctgggaagcacgcttacccttatttactggattgttattttcattgcggtaattactaccggtccaacctttgcattcagtatagcggcgcgttttatcaagctttggaagaattccgcgattgaccggaagcttaaggtttttgtcatagcacttgcctttatgattgtgtgttattttgtgtcccttatgggattaatgaaaattgtacagattctcctcacctccacgggggccatcggtgcgttttctatttttattccactgcttgtttccattttccgtatccacaagctgaaccttgcagaaaggagtgggagtcctgattgatgaaaagaactattaaaataattttgacccaattttggcccaataataaaaaaagtgcttgactaattgccacaatatgggtataattaatcccgcagctgttaatcaccagcgtgatttccaacaactgcgggattaaaaagttaatgatgggctatcgccaaacggtaaggcaacggactctgactccgtcatttcaaggttcgaatccttgtagcccagctaggaagaagctggccagcataagacaggtgcttatgccggacagctttttgcatttcatgggatggcggatatcactgccgtgtatatctttttgagaatccataatgacagatattggtcaaatgatattgtgaaaaaaatttcattttatatattgatatattttgccgatcatggtagaataatgaacggtcaacagatacatgattgggctatcgccaaatggtaaggcaacggactctgactccgtcatttcaaggttcgaatccttgtagcccagctaagacaagtctttagatatgaggagaggtccttatgtttaaagactttttttacagggtggttttaacgggatgggaacgttggacaataggtcatgagggaaggcatgggggatgacgcgatgacggttggggatgcgcttgagatttcagatatattaaaggatgccagtccgtccagcagggcagaaatcatgtcctttgcctatataaaagggtatgagaaggggcagcacgtgttttacgatagtgaggagctgtcctgtttctatattataatagaaggacttgcctccctctataagctgaataccctgggggaaaagaaggtggtattcatatacggacctggaaagatgctcaatgaaatcatgttccaggacctgccggtatccattaactgtgaaatccgggaaagggcccaggtgctggtgctttccaaggagcggttctggcacgtgatggagcgggaccctggattgaccagggctgcctttgacgccatggccctcaggatacgcaggctttacagacagcttaagaacaccaccaatgccatgaaaggtgaaaaaaggctggctgcaaagctttacaagctggccagggactatggggtcatgacggacaagggggtgctgatccagatgcatctcagcatcacctacctgtcggagatgcttggctcccagagggagacggtatccagacaggccaagaaattaggggatttgggtcttatatatgtggaaaagaaccatttctgggtccctgatttagaaaaattaagtgattattttaagcagccgtgatataaatcacggcattttttatttttatctgttatagttaaattattaacaaagaaaaggagtatatgctgcatgggataccgtctgcgggaagatgaactgcgtcagttgtttgagatgtggaaccgggattatgtggtttatggaccgaagtgcatgaccggggaagggatgtattcggatacggatgtggtaagatatgagcggctgaaagggtttgaggaactggaatgggaaaagaagtccgcttactcatttaaggaggcagtcctgccaattacacagatcctcttttattttacggaaggggaggtaaaggaggctgagcctgagaggaggaaaccggcgcttctgattatgagaagctgcgatatccatgcgcttaaaaggctggatacggtttatctggataaccgctttgaggacagctattatgcgcgcctgaggaaggggctgcgccttgtgcttttgggctgcagcgaatcctgtgacaacgggttctgcgtgtctatgggaaccaaccggacagaggaatacgatgcagccatgaatataaagacagtggacggacaggtccaggcagaattaacaggcagtatggacggactggacgcctggctggatggactgggagccggtatgacagaggctgcgccggattttgtcagtgaaaaccatgtgaaggtaaggataccggaggaatgtgggcctgagcatgtaaaggccggtctgtggaaggattatgacagccgctgcattggctgcggccggtgtaactttgtctgtcccacctgcacctgctttaccatgcaggatatattctaccaggacaatggaagggcgggagagcggcgcagggtacacgcttcctgtatggtggacggctacacggatgtggcgggcggaggctgttaccgtaattccaaaggagagcgcatgcgctttaaggtcctgcacaagatatctgattttaagaaacagttcggataccagatgtgcgtgggctgcggccggtgtgacgacatctgtccggaatatatctcattttcagcctgcgtgaaccgtttggcggatatgggaaatgccgaaaaggaggtgcgctgatgaagggccgggagtatgcaccatttttgtcaaagatagtaaaggtaaaaaaacatacggagattgagtacaccttttccatggagtattttggggatgtgaagccgggacagttttttgaggtatccatcccaaagtacggcgaagcccccatctcggtcagcgggatcgggccggactacgtggacctgaccatccgccgggtgggccgggtgaccggagaggtatttgaacggtatgaaggggattccctgttcatgcgcggaccttatggaaatggttttgatgtggatgattataaggacagcgagcttgtagtcatcgccggaggcaccggggtgtcgccggtgcgcggcgtggtggagtatttttcccatcattccggggagcgtaagggcatgacattgattgcgggttttaaaagtcccggtgatatcctgtttcaggaggattttaaggaatgggatcagaccatggacctgatccttaccgtggacggggcagaggatggctatgggggaagggtgggacttgtgacaaagtacatatctgacctggaccttaaggacgcgtcatctgcaaaggccatcgtggtgggaccgccggccatgatgcgcttctctgtcaaagggcttttggagcgcggcttcctggaggagaatatctgggtaagctatgagcggaagatgtgctgcggaatcggcaaatgcggacactgccgcatcggggataaatacgtctgtgtggacggaccggtattcccctatacggtgggaaagaacctgttggattaggaggcgtgtaatggatatcaatacaaagaagttaaaaaagaatgccttccgggtcaccaaggagcgcggactgaccgcatcccgcgtcagggttccgggcgggcacctggatgccaggtatctgtcaatgatacaggagattgcccagcagtatggcaatggcagcgtccacatgacggtgcgccaggggtttgagattcccggtatccggtatgaggacatggataaggtaaatgaacttttacagcccatcatccagggcatcggcattaaccaggataagccgggctgcggctatactgcgtcgggcaccaggaacatttccgcctgcgtgggcaatcaggtctgtccctatgcatgctatgataccagcggatttgcatttaagattgaaaaggcggtatttcccaatgacctccatgtgaaggtggccctgaccgggtgtcccaatgactgcgccaaggtcaggatgcacgactttggcatcatgggaatgacgcatccggaatacaggcaggaccgctgtgtcagctgcggcgcctgtgtgaaggcctgtgagaaaaaatcggttggcgccctgaaaacagtaaattaccgggtgcagaggaatcatgagaagtgcattggctgcggcgagtgtgtaatccagtgtcccaccagggcatgggtgcgcagtgggaaaaagtattaccgcctgacccttcttggaaggaccggcaagaagaatccgcgcatgggggaggatttcatcaaatgggcggatgaggagagcattataaaaatcatcactaatacctatgagtatgtgaaggaatatattgaccccgaggcgcccgggggcaaggagcatatcggatatatcgtggaccggaccgggtttgaggagtttaagaaatgggcccttaaggatgtgaccctgccggatatggctgagcttgcggagcggatttactggagcgggataaaatattaatggggaaggagtaaggaacgcatgaaaaaggtacaatcaacctgcaactactgtgccctggactgcaacatggatttttatgtggaggatgggcggatcgtgaaggtgctgccgaccaaggggtatccggtcaatgacggcttctgctgtatcaagggactttccctggacagacagcagaccgtggtcaagacatcgccccttccaaggatacgccaggcagacggctccatgaaggaggtctcatggaatgagggtttttctcatgtggcggataagctgaaggagctgcaggagaaatacgggaaggagagcgtggccggaatcagtacgggacagcttaccatggaggaatttgcgctgttcggtcatgtgatgaggaattatctcaagaccaatgtggacggcaatacccgcctttgcatggcgactgccgtggtggcccataagcagagctatggatttgacgcgccgggatataccctgaaggacctggagctttccgacaccatcgtatttgtgggagccaacccggtggtggcacacccgatcctgtggaaacgggtgcgccagaaccctgacaagaaggtgattgtcattgaccccaggaagtcggagacagccatgaacgcggattactggtattcggttaaatgcaggggggacctgaggctgttctatatcctggcaggcgtgctcattgataagggatatgtctgtgaggaatatatagaagcgcacacagaagggtatgaggaatttaaggggtttgtgaaggattataccctggaccgggcagaggagatgaccgggctttcaaaggaacagatccttgagctggcggagctgatccacagcgggaagcgtgtctccttttggtggaccatgggcgtgaaccagggatacgaggccgtgcgaaccgcccagtccatcatcaatatcgcgctgatgacaggcaacataggacgtccgggaaccggggccaattccatcacaggccagtgcaatgccatgggctccagggcctacagcaatacggcggtcctgtacgctggcggggactttaccaatccggccaggcgcgccagggtggcggaggcgctgggggtggacgaaagcgtgctggctgagaagcccacagccacctacaaccagattattgagggaatcaatgagggaaggatcaagggcctctggatcctctgcaccaatccaaggcacagctggaccaacaacgagacatttgccagcgcggtgaagaagctggagctgttcgtggttcaggatatctatgacaccattgagagcgctgaggaatgtacggtattcttccccgtggttccgggaatcaagaaagagggaacctacatcaacctggagcgccgcctttccgccatgcgcccctgccttgagaaaaaggaaaatgagattacggactacgaggccatcctgggcgtcggaaaggccctgggcatgggcagtctcctgaacggctgggagacgccccgggactgttttgagctgatgaagaaatgttccaagggcatgccctgtgacatcaccggaatcacctgggaaatgttagaggattcccacggtatccagtggcccttcagggaaggggacgccctccaggaggatgagcgcaggctttacggcgacggatgcttcttcacgcccagcaagaaggcgcagtttaagtttgaggcgcccaaggagaacccgctgcctgccacagaagaatttccatatatacttaacacgggacgcggctccgtgggacagtggcatacacagtccaggaccagcgaggtacagtttatcggggatgtgtcggcaaaggaggcatacctgtatatgaatcctgacacggccgccgccagccatattgaggaaaacaactggatcaaggtccactccgccaacgggcagcaggctgccttccgggtcaggatatcggagcaggtaaggcccggggagctttacgcgcccatccattacattgaatgcaaccggctgaccccatccatttacgacccatattccaaggagccatcctacaaggcaacgcctgtgtggtttgagaaaacagaaggaggaaatgcatatgctgcggattaaaattgacaggagccgctgcatcggctgcctgacctgtgtcacagcctgtgtggtcagccatgaaagctgcgacgccaggaaccgggtggtcattgacagccaggcaaaatgcgcgcccatattctgccgccattgcgagcgcccggaatgtgtctacacctgtatgaccggggccatgcataaggacccggataccggcttcgtggaatatgacagggagaaatgcgccagctgttatatgtgcatcatggcctgtccctacggcgtgttaaagagcgaccggctggagcataaggaaatcatgaaatgcaacatgtgcgtacaccgtacagaagatggttcccctaagcccatgtgcgtggaaatctgtcccatgaatgcaattacactggaggaggtggatgtatgagatatgtggtattaggcgcgtctgccgccggggtaaacggtgtgcggcagctgagaaagcagtgcccggaggctgaaatcatcctggtatctaaggacagcacggtatattcccgatgtatcctgcatcattatctgggaaacatgcggacaaaggaggagctttgttttgcagaggaggattttgaggacaggtacaaggtggactggaggaaaggcgtcagctgtacggcactggatgataaggaaaaaaaggtcatcctctcagacgggaccagcatttcctatgaccggctcctgattgccaccggctcccacacgctccttcctccggttaaggggcttctggaaacagaaggcgtatacggcttccataacctggatgaagtggagtccattaagaaacgggccgggaaggcggaacacatcgttgtcatgggcggcggccttacgggactggacgcggcggttggattcctccaccttgggaaaaaggcggacctggtagagatggaggggcatctgctggcaaaacagctggatgcaagaagctcaaaaacctacgaggaggccatggaaaatgagggcatccgcctgcatctgggcgtgggtatccgggaagtgtgttcggaaaatggaacaatcacatccctgaagctgacggatggttcagagctggcatgcgatatgctggtagtcactgcgggcgtgcggccgaacattgatttcctgaaaagctccggtgtggagtgcgaccagtttggtcttgtgattgaccggtacgggcagaccagtgttcctgatatttacggcgcaggcgatgtgaccgggcgttcccccatctggcccgcggcagtgaagcagggcatggtggcggccgtgaatatggccatggatgatgcgcaggaaggcagacgggcagccatggatgatgcgcaggaaggcggacgggcagccatgaatgattcgcaggaagacagacgggcaaccatggatgacttctttgccagtaaatccaccatgaatttcctggacatacccaccatgtcattgggtatcccggagcggccggaccacagctatgaggtggttttggaagacagggacggcatttaccgtaaggtcatccataaaaacggaaagatatacggggcaatccttcagggcgacctgtcctacggcggtgtgcttacccagctgattgcaagtaagattgacgtatccaaagtgaagaagccattatttgagattgactactcagattttttccatacaaaagataattttgaattctattatgaggaggcttaagcctatgaaagagagactgaaaaacatgcccatcccggtagtggcaaccatgctgggcgcggcaacgctgagcaatatctatcagggacttggatatgactgggtccgccatctgaccatgtgggcggccacggcagtgctgcttttttatatcgggaaaatcatcctttacccttcggttgtaaagggggagtataagaatacggtcccggccagcctctatgcgggaatcaccatggtaaccatgattctgtgcagctattataaggactgggcgccgggtccggccaggattgtcctgattgcggctgtctgtatccacgccgtacatatcctggttttcctgtttaacaatgtgtttcacggcgtgaagctggatacctttgtcccaagctggttcgttacatttaacgggatcatggtatccaccgtggtaggcttggccatgctgcctcccatcatggcaaaggccgtgctggtatgggggctgtgcatttacaccatcaccatccccttcatggtgtggaggctggccacaagggaagtcaaaccggctatgtgccatacccaggccattgtgctggccccctgcagcctttgcctggcaagctatctgaacctggctcaggaacccagcatggttcttgtgggcgtcctgtttttctgtgttcttgcctcgctggtattcatcattgtcaagctgcccgtattttttgcggttccctttgcgcccggttttgcaggacttaccttccccatggcaattgggatcgtggcctccaacaaggcggctgcctttttcactggcgcgggccaggagacccttggctatgtggtgaaacagattgcgggtatacagatttacctaacaacggccatcatcggcatggtattgttcggtttcctgaaaatgctctttggccccggcaaaaaggcggcttaacaagaatccggctttcacttatggcatggatggattcttgatcctacatatgcgtccgcttaggcgggcgcatatttttatggacaccttccgggaactggtatataattttcctaacaagtataaggatgtggctgaaaattgctttccgccgtctgccctgtggggagctggcggtggacttcttagggcagttggcgggaatggatttccggacacaccccgggtatggctgaaccatcatttccgcgggatgatggatgttcggacatttcccggagggaaggggaggttcacatgaaaattctggttatcaacagcggcagttcctcactgaaattccaggtgattgattcggaaaccgagcgggtccttgcaaaggggctttgtgaacggattgggattgacggccgttttacctataaaacagatacaggcgtgtcattgaaggagccggttcccatgaaggaccacaagcaggcggtacataccatactggatatgctgtcggacccggataaaggcgtaatcagggaattttcagagattgacgtggtgggacaccggctggtccacggaggggagaagttcactggctctgttgtcatcagcgaagaagtcattcatgccatgacggagtgtaatgacctggcgcccctgcataatcctgccaatctggtgggggtggaggcctgccgtgaactgatgccggacaccctgatggtgggggtatttgatacggcatttaaccagaccatggagccaaaggcatttctgtacggccttccctacaagtactatgaacggcataaaatccgccgctacggttttcatggaatcagccataagtacgtttcccgcagggcggcccagttcatgggacaggacccggggcgggtgaagaccattgtctgccacctggggaacggcgccagtatctgtgcggtcaaatacggtcaggtggtggacaactccatgggattcacgcctctggaagggctggtgatggggacccgctgcggcgatgtggatgcgggggcgctggaatatcttgctaagaaggaggacctggacatcaagcagatcgtggccatactgaaccaggaatccggggtactgggcatatccaaaaatttttccagtgactttagggaattaaaggatgcggaaatcaaataccacgaaaaggcaaccctggccagggagatattcgcatacagggtggccaagtacgtgggcagctacgccgctgccatgaacggcgtggacaacattgtctttacggccggaatcggtgaaaatgattccgatatacgtgaggagatatgcagttatctggaatacctgggcattaccattgacgaggtaaagaaccgggagcaggcagaggccgtgaagatatcagacggcacctccagggtcaatgtactggtcataaagaccaatgaggaactggagattgcccgggaggcggctgccgtggcggaagggcttgtataatccggtttatctgtgatacaatgtcctggtacactgacgctgtacaggaagattcatgataggattcatgacgaaaggcgaaacgaaaggcagaacgaggtaaatatgtatacgattaacagcagggtccgttatagtgagacggacgaacgcggacagctctcccttactgggatcatcaactatatgcaggactgcagcacgttccagtcagaggatgcaagggttggtgttaagtacctggatacaggccacagggcgtggcttctgtcctcctggaggattatgattgaccgctatccaaagcttggggaatggctggtggtagggacatggcattgttcctccaaagggatttacgggtaccgtgatttcgtaatccaggacgaaaaggggcatgactgtgtcagggcggcttccgtgtggtttctctatgatacggagaaaaacatgccaatccgggtacagccggaggacacggagccttacggtgacagggaaccgccccttgaacttggcccggcgccaaggaagatagcggtgccggtaacttatgagacaggggaacccatcgtggtggcgcggcatcatattgataccaaccaccatgtgaataatgcccaatatgtggatatggccagggaatccatcccggaagggcttaaaatcagggaaatacgggcagactataagaaagcggctgttctgggtgatgtcatcattccccatgtcagccaggagccggaccacgtgtggacggttgccttaaacaatacgcaggatgacgcctacgcagtgatatggctgcggaccgaaccggaagaagaggccggaccagagggggagaaagatgattgaattaggaaaagtacaggaacttgaaatattaagggaaaaagattttggcgtatacgtcggtgagaatgcaggggatgaggcatcggtcctccttccaaaaaaacaggtcccggaaggggcaaaggtgggggataagatccaggtattcatttacaaggattcctcggaccgcctgattgccaccacggccgcacccaagctccaggtgggggagaccgccatgctggaggtaaaggatgtggcgaagataggggcttttctggacatgggattggagaaggacctgctgctgccttttaaggagcagacccatccggtacgcaagggggagcactgccttgttaccctttacgtggacaagagcagacgtctggcagccaccatgcgggtatattcccatatgagcaaccagtccccatataaagcggatgactgggtgaacggtacgatttatgagattaatgataccattggggcatttgtggcagtggacaataaatattatgggctgataccgaaaaaggagcttttcggaaggttccgggaaggcgatacggtgcaggccagggtgaccagggtgcgcgatgacgggaagctggatctgtgcgcgcgggagaaggcccatgtgcagatggggacggacgcagaggccgtgctcaaggtaatcgatgactttgacggggtgcttccttttaacgacagggccaacccggatgtcatcatgcgcgagttccacatgagcaagaacgcatttaaacgtgcggtcggccgtcttctgaaggaaggtaagatccgcattacggaaaagaccattgagcgtatataaatgcagataaatgtgtataaatgcagataaagatgcgtaaccggcaaccggagtcatcaggcagtcccatatacggcggctgcctttttatgtaccggggcatgccgtgggcgtggatggatttacagggatgtacggggatacgcggatgacggagcgcaagtttcaattacaccttagggcctgtttgaaaattcattcccgccatctgcacgccccacttcgtggcatatttggcccaaattcacttaacgtagcccgctacgccgcgttcatttgggccaaatctcccacaaagtgggacgcacagctgacggaaagcaattttcaaacacaccctagcgtggggagggagatatgactatgaacagaagaagcccggcagtagattatatccttattgtggcagggacattccttattgggtttgcaattaaaaatatctatgacccggtcagcatggtaacaggaggcgtgtccggcctggccatcattgccaaggagctgtggtccgttcctttgtggctgaccaataccgttctcaatatcccgctgtttgccgcgggcctgtttgtcatgggatggaagttcatcaagcggaccctgtttgcaaccgtgatgctttccgtttccctctatatcctgcccgaaggctcttatatgggaaatgacatcctgctgtcagcactgttcggaggtatcataagcggcgtgggcaccgggatggtgtttttgaccagctgtaccactggcggtaccgatatgctggcagccctggtacagaaacggatgaagcattacaccctggcccagatcatgcaggtgctggacgggctgatcgtgatagccggcgcatccgtgttcgggatcagaagcgccctgtacgcgctgattgccatcttctgcgtggcaaaggtaacggacgggctgattgaaggactgaagttttctaagcaggcatatatcatttccgatgtgtatggacagattgcggatgccatcatggagcgcatgggccgtggggtcaccagcctggacgccaggggcatgtactctgaccaggagaagaaaatgcttttctgcgtggtttccaagaaggaaattgtgcaaatcagagaaattgtggccgagtttgaccccaaagcctttgtgattgtcagcgatgcaagagaagttttcggtgaaggattcattgaattccattgatttccgggtttgattaacataattaacaaaaaatttacggaaaatattggaatgcattgtgatttacagcacattttttttttcgtatacaaattagctaaatccccaaaatggattttgtggatttacaatatggattcctcatttgctttcatgtatgatattaacagttacacgaaaggcgttcatgcatgtaagcaaagcgaattttaggaggaaaagacaggatggctagtttattactgaagaatgtaactaagaagtatccaaacggtttcgttgcagttaaagagtttaatctggaaattaaagataaggaattcatcattttcgtaggaccttcaggatgtggtaagtccaccacccttcgtatgattgccggtctggaggacatttcttccggcgagctttacatcgatgacaagctggtgaacgacgttgaaccaaaggacagggatattgcaatggtattccagaactatgcactttacccgcatatgtccgtatatgacaacatggcattcggcctgaaactgaggaagacaccaaaggaagaaattgaccagaaggtacgtaacgctgctaagatcctcgacctggagcatcttctggaccgtaagccgaaagcgctttccggcggccagagacagcgtgttgccatgggccgtgccattgtccgcagccccaaggtattcctgatggacgagccgctgtccaacctggatgccaagttaaggggacagatgcgtgttgagatttccaagcttcatcagaggctggagacaaccatcatctatgtaacacatgaccagactgaggccatgacactgggaaccaggattgtagtcatgaaggacggcgtgatccagcaggtggacagcccgcagaatctgtatgataagccatgcaacaagttcgttgccggattcatcggagcgcctcagatgaacatgattgatgccgcagtgggcaaggatggcagcgatgtgaccctcagctttggcggacatacggttgcacttccggaaggaaaggcaaagaagctggaggaagcaggctatgtgggcaagacagttacccttggcatccgtccggaggacctgcatgatgaggaatccttcctttccatgtcgcctaagagcgtatttgatgcaaccatccgtgtatacgagatgttaggctccgaggtcctgctgtactttgatattgatgatgctgactttaccgccaaggtgaacccgcgcaccactgcaagacccggtgataccatccagctggcactggatttagagaaaatccatattttcgataaggacacggaacttgtggttcttaactaagtttcataaaccgtaaatgaaatttaaggtaaaaagaagcaggagagcatacaactctcttgctttttttgtaattttgcattaaaatatgaaaatagggatattagttactccgaatacgtttgaaaaggagattatagaatgatttcaaatcagatacttcagaccacacttgatggattaaaggcaattacgagaattgatttgggtatatgtgatacagagggaaaagtgctggcatccacatttacagatgcagaggattccgaaagctccatattggtgtttgtggattcaccggcagacagccaggtgattcagggctaccagttctttaaggtgttcgatgagcaccagctggaatacatcctccttgccaagggtgcaagcgatgatgtatacatggtggggaaactggccgcattccagatccagaacctgttagtggcatacaaggagcgttttgataaggataacttcatcaagaacctgcttctggacaacctgctgctggtggatatctacaacagggccaagaagctgcacattgacacggatgtaaagcgtgtcgtatttatcatcgagacccataatgagaaggatgtcaacgcgctggagacagtaagaagcctgtttgcatccaagaccaaggacttcatcacggccgtggatgagaagaacatcatccttgtgaaggaagtccgtcagggcgagtcctacagcgagctggacaagaccgccaacaccatcctggatatgctgaacaccgaggccatgaccaaggtgcgtgtttcctatggaaccaccattaatgatattaaggaagtgtcacgttcctacaaggaagccaagatggccctggatgtaggaaagattttctatgccagcaagaatgtgattgcatacaacaacctgggaatcggacgcctgatttaccagcttcctattccgctgtgcaagatgttcatccgcgaagtgtttgacggcaaatcaccggatgattttgacgaggagacacttgccaccattaacaagttctttgagaacagcctgaatgtgtctgagacttccagacagctgtatatccaccgcaacaccctggtataccgcctggataagcttcagaagagcacaggcctggatcttcgtatctttgaggatgccatcacattcaagattgcgctgatggttgcaaagtatatgaagtatatggagagcttggactattaaaccggagtaacagatgatagaattaagtcgcgtatgcaagacctacgaaaccggcagcaaggctgtgaaggatatttcccttaccattgatgacggggagtttgtattcatcgtaggcaggagcggttccggcaagagcacgctgatgaagctgcttttaaaggaactggaacccacaaagggacgtattgtggtgaacgatatggacctgggaaggatgccgagacggtatattcccaaatatcggagaagattaggcgtggtctttcaggatttcagactcctgaaggaccgcactgtgtttgagaatgtggcatttgcccaaagggtaatcggggtgccgggccgggtgattaaagagaccgtgcctgagatgctccggctggttgggctgtcttccaagtataaggcctatcccaggcagctttccggaggagagcagcagagggtggccattgccagggctctcatcaataacccggaagtacttctggcggatgagcctaccggtaatctggacagctttaacacccatggaatcatgaagcttctggaggagattaaccagagggggacaactgtgattgtggtcacacacagtcaggaaatggtggatgagatgaataagcgtgtcattaccatggaacgggggtcgattatcagtgatgagaggggcaaataaacagcaatgaggatcagtacattttggtattgcctgaaacagggcgtcattaatatatgcaggaatattttgttttcgctggcttccatagcgactatttctgcatgtatttttttattctgtcttttttttgccctggtggccaatgtgcagaatgtttcgaagacagcacagacaacggtcggcataaccgtgttctttgacgaacagcttccggaggaacagatcctggctgcgggcgatatcatccgcggctggggggaggtcagggaagtcaactatgtgtcggccaaacaggcatgggagaattttaagacacagtattttgaggggatggaggaactggcggaagggtttgcagatgataacccgctgtcaggctctgcttcctatgagatattcttaaacagcctagaggaccaggatgggattgtcaaccggctggagggcatggagggcgtgcgcaaggtgcgctattccagcgcggccgtggcaggctttaccagcgcgggcaggatgattggggcattgtccgtggtcattatcggcgtgctgctggcagtggccgtgttcctgatcagcaacaccatttcggtggcagcctccttccggcggcgtgaaaatgaaatcatgcggttcataggggctaccaattatatgatacgggcgccgtttgtggtggaaggggtgctcttaggcgcctttggggcggtaatccctttgatcgggatgtatttcctgtatcagaaggcggtcatctatgtaaatgaacagtatcagatgataacagggcttttcaggcccattgccctgggggatattttcccttatatggcaggtacggcaggcgcgctggggattggaatcggcttctttgtaagctttttcacgattcaccgccatctgaaggtttagtgcctgtctgaaacgttgggaaaggagcgttccatgaagggaaacagacggatccgggcagcggctttggccggcggcctgcttctgggagggatggctgcattttcctcctatgccacaagcgtggagattgaggacgccaagaagcaggtttcggccctggaagaggaaaagaaaaaagtagaaagcaccctgaaccagctggaaacgttgaaagcggatacggctgcctatgtaaagaagctggacggcagcctgtcggcattgtcagatgagctgtcccagctggagacacagattacggtcaaggaatcggagatagagacagccagggtgcagttagaggaagcaaagggtgtggaagaacaccagtacagcaccatgaagctgcgcatcaagtacatgtatgagaatggggagagcagctttgtggacatggtcatggagtccggaagcatttccgaacttctcaacagggctgaatatgtaagccagattgctgaatatgacaggaagatgttaaaggaatatgcggctgcaaaggatgaggtggcggacagggaactggcccttgaggaagaacaccagggccttctttcgttacaggagactacccaggccaaacaggcgtccatgcagaagctgatggattccaaaaaggcagagctggattcctataattccaagattgcatcggcccagtctgagatagaccagtataatgcggacatcaaagcccaggaagaccagatgaaaaaaatcgaggccgagatgaagcgcagggaagaggaagccaggaaaaaggcagaggcggccggcaaaacgtataccgtgtcaaatttggggaatattagctttaagtggccctgtccatccagcagccgcatcacctccaatttcggggacagggaatcgcctacggaaggcgcttccagcaaccacaagggaatggatatcggcgccgcaacgggagcggatatcattgcggcggcggacggagaggttgtgatttctacatacagctattcagctggcaattatatcatgcttgaccatggaggcggcgtcagcacggtttatatgcactgctccaagcttttagtgggcgttggggagaaggtgaagcagggacaggtgattgccaaggtgggttccaccggctattccaccggttcccacctgcactttggaatccgttcaggagggacttatgtgaatccccgcagttatgttagcccctgatgcgtcataagtatagattagaagggacagataggagacttaaattggataatcgcgattttgatcaacagagaaatatggatgggaacggcaatccggacggaggcgcggggcgccagggtaatggaaggaaccggttctgggccggtgtgctggccggggccttggttactgcctttgtgggcctgattgtggtgggaatgtcggccggcatatacattttcggaaaaaaggtgttgaaccatcagccgggtgcccagacagagggacgggcgcccgcgatctcaaacgggaccaagaagccggaaggcgtggattttgggcgtgtgacggccaagatggatttaatccagcagatcataggggaatacttcctgtatgaagaggatgcggaaaatgtggaggactttatctaccgcggcatgctggctggcctggatgacccttattccgtgtactatacgaagtccgattatacgtcgcttcaggacagcaccaagggtacctattcaggtatcggtgccatgatcagccagaaccgtaccaccggactttgcaccattgtaaaggtatttgaaggatcgcctgccctggaagcaggcatgcagcccggcgacatcatctataaggttggggataccatggttgcctctgagagcctggatgtgctggtgaacaactacatcaagggcgaggaaggcactccggtggagattacggtttaccgcgcggataaggatgaatatgtggacctgaccgtgaaacggcgtaagatagaggtgcccaccgtggagcacaggatgatggacggcaatattggatatatcgctgtcagtgaatttgatgtcatcacagtggagcagtttgaagctgccgtggatgaacttcagaaaaatggaatggaaggcctgatcatcgacctgagaagcaatccaggcggtgtcctggacggcgccgtgaagatggcggattacctgcttcccgatgacatttccaagtatgacaagggagagggcaagaccctgattgtgtacacggctgacaagaatgagaagggcgatgtatataccgcatccgacaagcatgagcttgacctgccgattgtcatactggtaaatggagactccgcaagcgcttcagaggtatttacaggcgccatgaaggattatgacagggcaaccgtggtggggaccaccagctatggaaagggaatcgtacagaacctgattcctctgggggacggctctgcaattaagattaccacagcccattattataccccaagcggatttgacctccatggaaaggggattgagccggacgtggaagtggaactggatgagaagcttaagacccaggccgtggtgaagccggaggaggataaccagatccagaaggcggttgaggtgctggaaggcaagctggggaagtagacggcgttgtttattgttagggacgatgagatggatgggagtgacctgccggtggcagtcactcctgttttgctgtttggattaaccgggatgttgcctgctggaactgagtcctggttgccggaccaagcccctgactgtcggattcgctcctgtccgtaattttaataccttatggaagacggttcaaccggacaatacagatattggggaaacagaacaaacattcgattacggtctatactttctaagggcaatctggtataatgaatgaagtgtgttatggataatgtaagttggacaaaagagtaagaaattcattataaaatcttataggatgctattttgtgctgttcagtagtaaataatatagttttattagcagttaaattctgaaatttgagagtacggccattaggcagctgcccagatacctgatttcaaagattttacggatttctgcttaacagacgtacttttaattgggtcatcaaggaggtaaaaacgcattatggagttcaaattacacagtgaatatcagcccaccggcgaccagccgcaggctatcgaagcccttgtcaaaggcttcaaggaaggtaaccaattcgagactttactaggcgtcacaggctccggtaagacctttaccatggccaacgtaatccagcagttacagaagccaaccctcatcatcgcccacaacaaaaccctggcagcccagctctattccgagtttaaggagttcttcccggagaacgcggtggagtattttgtgagctactacgactactaccagccagaagcctacgtgccgtccacggacacctacattgaaaaggattcatccatcaatgatgagattgacaagctgcgccattcggcaacggccgccctgtcagagcgggaggatgtgattattgtggcgtccgtgtcctgtatatacggcctgggaagtcccattgactataaggagatggtaatatcgctgcgccctggaatgataagggacagggacgaaatcatccacaaactgattgatatccagtatgaccgcaatgacatggattttaagcgtggtactttccgggtaaggggggatgtgctggaggtatttcctgcgtattcggacagtgcggcttacaggatagaattctttggggatgaggttgaccggataacggagattgataccctgaccggagagattaaagcccagctggggcatattgccattttcccggcatcccactacgtggtgccaaaagagaagatgatggaggcaacagagaatatcctggctgaactgaaagaacaggttgcattttttaaaagcgaggataagctgctggaagcacagaggatttcggagaggactaatttcgatgtggagatgatgcgggagactggtttctgctctggaattgagaactattcacgccatctgacaggagggcttcctggtgaaccgccttgcacgctgattgattatttcccggaggatttcctgatcattgtggacgagtcccatattaccctgccgcaggtcaggggcatgtacgccggggaccggtccaggaaatcaacattggtggattatggtttcaggcttccttccgcgctggataacagaccccttaatttttctgaatttgaggataagattaatcagatgatgttcgtatccgctactccgtccgtatatgaacgggaacatgaactgatgcgcgtggaacagatcatccgtcctaccggacttttggacccggaagttaccgtacgcccggtggagggccagatagatgacctgatttctgaagtgaacaaggaagtggcaaaccatcataagatactgattaccacattgacaaagcggatggcagaggaccttacggattatatgcgcgaggtggggatccgggtcaaataccttcattctgatattgatacgctggaacgggcacagatcatacgtgatatgcgtctggatgtgtttgacgtgcttgtgggcattaaccttttaagggaaggactcgatattccagagattacccttgttgcaatcctggatgcggataaagagggcttcctgcgttctgagacttccctgatccagacaatcggccgtgcggccaggaactcagaaggacatgtaatcatgtacgcggataacatgacggattccatgcgcgtggctatcggggagaccaaccggcgcaggcagatccagcaggcatacaacgaggagcatggaattacgcccacaaccattaaaaaggcggtccgggacctgattgccatatcaaaggcagtggcagataacgatgagaagtttaaaaaggatccggaatccatggatgagaaggaactcaataagctggtcaaggagttggaaaagaaaatgcgccaggccgcagtggaacttaactttgaggaggctgcaaggcttcgtgaccggatgatagaaattaaaaaaatactcatagatatggaataatttgtaacttgtcctatccacagggattgtgtttgaaaaatgtaatattcttttaaggattattaaattgtacaatatcaatagctttattataataaagataggcaattggtagaaaattcatataatggtggataggaggagttgttatgagaaaaaagaaaggtatatgcttattgttagcagttgtcatggcaatcagtaccggatttaccgccttggcggcagatacgaagattgatacggtgaagcttacattttcatatgataaggcacctgcaagcggggacaacataggtaatattaaggtcaaggcagacagcagtgagttttatgtggaatcagcagaatatacgaattcagatgaccaggatacatggaccgtgggggatgtaccggaggtgaagattgaactgtcagccaaggatggctaccgtttttcctacacatccaagagtcactttaaatttacaggatgtaatgccgagtttaagaaggccaagatttatgacagcggcgcgtatatagaggtatatgcggaactgaagcgcattggcggtaagctggaaggcgccacggacctggactgggaagataccacggctgtatgggaagagattgaaggagccaagagttatgatgtgaagcttctcaggaatgataagacagtgacaactgtgagcaccaccaggacatcgtttgattttgcaggatattttaacagggaaggtgattataccttccgggtaagggctatatctcggtataacagtaaggctggtgagtggtctgaagattccagttccttttatgtggatgaggatgaacttggaagatacggcggcagcggccactgggtccaggaccagaaggggtggtggtatgcctttgatactggcggttatccatcttcctgctggaagcagattaatggagcctggtactattttaacagttcaggttatatgttgaccggctggcagcgtctggacagggattggtattacctgaatcccagcggcgccatgacaacgggctggcaggccatcaatggccagtggtattatatggacggcagcggtgtgatgcagaccggctggcaggctgtgaatggaagatggtactatatgaacagcagcggcgccatgcagaccggctggcagaggcttaatggccagtggtattatctggatcccagcggcgccatgcttacgggctggcaggccattaacgggaagtggtattatcttgggagtaatggcgtgatgtatgccaatacgaccacaccggatggccgctatgtggggtccgatggggcttggcaatgagccatgagtgtgataggacagaaataaacatataaatcaaagattctgccgcttttgtctgataagaggaagaggactaaacctagcaaaacttaattgttagatttagtcctttttttgagctgtcaatatcagtgaggtgttccctggttctctgacccctcatgtccatacccgtctaaggagccgttttcttcccaataatcaaatctcttagtaatttctttgtgcgtttcttcagtgatagccggaagtttgtcccccattgataaccggcctggcggaatcccttttctaccgcttcccttaatcaggtaattattgaggcatcaccaccggataaggatacggccatgtccaccatatgggttgccatggcgtttacgccccattccccgttttttatacaaatgaatcagacattttttgagattacgaatcctggaaaaaataaaataactcaaataaattgtaattattttaaaaaatatgtcgatatctacagaagaggataaattttgatttacatgatacagagtggagatgaactatgaaaaggaccgcgatatttcttttgataagtctgttatctgtttttactgccatcacaggtttttgtccggtttccggtaccagggcgtgtttgaaaattcattcccgccatctgtgcgccccacttcgcggtatatttaccctaaattcgggtcatatagtccgctatgcgcccttcatttgggccaaatcccctgcaaagcgggacgcgcggctgacggactgtgattttcagacatgccccggtatttttggggaggaagctgagattcaaaagaaagaatcgactccggcagaatcagattctttggggatggaatatgaaggtgaattttctattgccgcgtattgtggatgtaaactttgctgcggttccggtaataaggtacagacgtattttgggacacaattgactcccggccattccatagctgcggatttccagcttttttccccgggtgacagacttcagattgaaggaacctgttacacggttgaagacagggccaggtctaattcatctgtttcacttctcgtatattttgattctcattccgaagcaattgaatttggacggaagacactgagcgtatatcggatttgtgaagaagaggcggttgtggaaggcgagcctctgggaacgttcaccgtaaccggatattgcagatgcagacaatgtacgggaatctacagtgaaaagaatatgacttttaccgggatggagcctgtgccaaaccaaaccatcgccgctgatccgagtatggtcccgctaaactcaaagctgttgattaacggcattgtctatacagtggaagacacgggaaagaatattaccgggcggcggcttgacatatattttgaaagccacgaagaagcggttacatatggaagaagggaggaaatggtttatctgattgaacagccggaacaagggggaggataagccgtcatcccttgacccatatatgccagtactggatattacggagacagtattgagttaaacttttggagagattctatgaaaaaggcaatgaaacaatctacactgatttacattttgaatggggtttctattttctcccttctgattacactcctcagcgtactttattatggcagcataaacagtaaaatccaacaggccgccaggaaccggtatgaactgacctataatgccaaccggttcatgaatgggtcggcgtacttaacaaatgaagtcagggcgtatgctgcaacgggagacaagactcattatgataattattggaatgaaatcaatgtcctgaaaaacagggatgcaggtgtggcggcgatgaaggagattgggataacccccaatgaacagtccatgattgaacagatgtcgtccctgtccaatgaactggtgccccttgaagaaaatgccatggattatgtttcggccggaaataagtccgcggcagttggatatgtatatggggatgattataatcagtcggttgagaagataaacaagctgaaaagtgatttcctcaccacgcttgataaaaggtcctccagtaatgtaaacagcctgatccttcagtcacgggtgtcgctttttttattgattctttccgtatttataacgatggcgtttcaggttatcatatcgcagatctcacgtaagaagatgattgagcctgtgattgatatcatgaaccagatgcgcgaaatagcaagtggcaggctgtcagtggaatttaacctggattcagacacgtccgaggtagggatgctgattgaatccatccattcgacgaaaaaggaactgaggaaatacatagaagatatcagggagaccctgacttccatggctaatggtaatatggccatacagaccggtaccgaatacaaagaagaattcaaaccaattcaggattccctgcagttgattctggaatccctgaaccgtgtgcttcatgatattgaagcggcagcggaacaggtttctgccagttctaaccgggtatcatcatttgcacagaccctttcacagggcgcaacagaacaggcagcctctgtggaggtcctgaacagggaaattgataacctttccacgcaattaacggaagcagcccagaaggcttccatttcacgggaggaatcaatcaatgccagcgggctgcttagaagaagcaatcagatgatagaaggattgtcaggaacaatccgggaagtatccagcgcctccagcaagattggcgggattgcaaaaattatagaagatattgcgtttcagaccaatatccttgcgttgaatgccgctgtggaggcggcaagggccggggaagcagggaaaggttttgccgtggtggctgatgaagtgcggaacctggctactaaaagctcagaggctgcaaaggataccacggcccttattaacgacaccttaaagctgattgatacaagcgccaaattaacgaccgataccgcaggatccctggcagatgtcatgatgggagcagagcaggctaccgatatggtgggggatattgtgcgcgcatcagaatatcaaagggaggccatccatctgattcaggagaatctgaatcagataaccgatgttgtacagaacaatgttgcaacggcagaagcctcatctgccgccgctgaagaactcaatcatcaggcggaagcgctgaaacagtccacacaacgttttatactgcgctgagaatggtgtttaatggagggatgcatatgacagaagaacaggcggttgcttttacaaaagaaatatgccggatgtattttgaagagcggaatcatgataaattgatggattatatctcaaaagacattgtctggattggggtgcgtggaaaaaaaggctttaacacatttgggaatctgcaggaatatcttcggattgggaaagaggtttatagcggaagtgtccatctggataatcaggaatgccgcgtactggaaatcacgaaggacctgacctgcgttttagcctgtatggatgtgtatacacccccagaagaaggacctgtttttacggaacatatccatattacaatcatataccgcagggagggcagtgaatggaaaatcctgcacgtccataattcctttgcggacgggacttatggggaaactactacggcggcggattcccggcactggagggatttcatgatgataaaagaagaggcaaccaggatggcggccaaggaagtggaggaagtcaggaagctggatacgcttaccggtatctataatatggaaggctttgctgagtgcctggaagatatcctgcagaagaatccatccaaacattacgtaatcttaaaatttggaatcaaccagttccggtatattaatcatgtgttaggttaccggacaggggattgtatacttagggaaattgcctccaacctgaagaatttatgtatcggcagtgaaatatgtgcccggattgaaaaagataattttgccatcctgcttcagtatgaaaaccgggaagagttagataagcggattgagagtttttgggggcgtttcatcagccaggagacagaggaggagctggacatcaacgtccattttaccggcggcgtatgtccgattgagccgggaagcagggaatccgtcaaacagatgttagataaagccatgctggcccagcattataggaaatcgtggaagtgggagaaccgttacatctactatgatccggaaatggaacgcaaccagctgatggaacaggagttggttgaaactgcaaggtatgcaatggaacgcaatgagttccgtatgtacttccagccgcaggtttatttggattccggtgaggtggcggggacggaagtactggtacgctgggtgaaacctgatggaagaatcgtcatgccggatgaattcatcccggttttcgagcagacaggatttataaagaccctggatttctatatgctggagaaagtctgcagccgtatgcggggctggcttgacgaggggcttcgtgtgtgccctgtttccattaaccagtccaggctccatctggaggaccagcattatgcgaagcagttctgcggagtcgtggaccgttatcatataccgcatgaactgattgcctttgaattgacggaaagtgcgttttcggaatatgatcagatgattcagaggctggccgctgaacttcactgctatgggtttcggctggatattgatgattttgggacaggttacacggcgcttaatcttttaatgcagattgagccggatgttttaaagctggatcggagcctgaccgcaaattaccagaatccgagagggaatctggtgcttaagaaaatgatagagattgcaaaggaaactgagactaccattatctgtgaaggcgtggaatacccggagcaggaggcgtatttcaggcatctgaagtgcgatattgcacagggatatcattattacaggcctatgccggaagaggattttgtggtaaaaatcctaaaaaaagcttgaatgcaaaagaatgacatcgctgaggcggtgttttttcttaccaataaaggaatggcatatggatggcttccaatctgcctgtatattttttatattccatgctgaaaaggattataaaattgcagaatatgtcgataaccatatagagaattatagaatcagagcctgggacagcagcattccttaacagaaacataaaaaataatggagggggaatatgggggtggccacaggaacaattgttaaaatcggcaagtgtattaccaaagaaaacttacaattaggagaaaacggtatgttaaataaaatgaaaataggaaaaaggctaactttgtcatttgccctgattattatggtattcatcatctcatccgctgtttcagcattcagtgtctattccgtatccaaaagtcttagtaaattttataatggaccgtttcaggtggtgaaaacctcttttgacatgcgaagggcgattcagagtgctgagcgcagtatcttgtggtcctgtacaacagaagacagcgccgccacagactcgcggctggaccaggcggctgcggacctggagatagtgagggatggaatcacactgctaaaggataaattcctgggagatatgagcctggtcacggaatttgaagccaccatggaggcgagcaaaatcattaaggatcaggtcatctcattgagcaaggcaaatcaggtggatgcatccattgccctgtatgattctcagtatgcccccaaattaatggaagcaaagggattgctgaatcagattgcggagttttcccaatcaaaggcgaatgaatttgatcaagacggtataaataccaggaatactgcatttatctccattgccatattaacggtcgcgattctcctgcttgtacttttcctgagtacaatattgaccagaagcctgacaaaaccgatttttgagattgaggaagcggccggccggatggcagaaggggatttaacagtaaagataggttacacggcacaagacgagctgggacatctcgcggaaagcatgaggaccatgacgcagcgtatctcctattatatgggtgagattacagtggcaatgcagcagatggcttcaggagatttgaatgttgcatcgcgggagacgttcaagggtgattttggccctgttcagatagcaatccgttccctggtaggttcgctgaatgatatccttatgcagattgggcagtcctcggaccaggttgcaagcggttcagaccaggtgtcctcaggtgcccaggccctctcccagggcgccacggaacaggccagctccgtggaggaactggcagccacaatcaatgagatttcctcacaggtaagggctaatgcaaagagtgcgcagcagggcagcgagctggcggaagattccgggaggaaaatggaggaaggcaaccgtcagatgcaggaaaccatagcggccatggccgagattaaagataaatcagggcagattgggaaaatcatcaagaccattgaagacattgcattccagacgaatatccttgcattaaatgctgccgtggaggcggcgcgcgccggggacgcaggaaaaggttttgccgtggtggcagacgaggtgcgcaatcttgccagtaaatcggcggaggcgtccaaaagcacggcagccctcattgaaggttccatgcaggctgtggaaagaggaacgaggctggctgatgaaacagcacagacgcttagcctggttgtggaaagctccaaacaggtggttgctgttgtggacgacatatcacaggcatctgctgaacaggcgtcctccattgcgcaggtcacgcaggggattgaccagatttccagcgtggtgcagacaaactcagccactgccgaggaaagtgctgctgcaagtgaggaattgtcggggcaggcgcagctgctcaaaaatctgcttagccagttcaagcttaaggattcttttaggaaagcagaaccagcttatgggcaggaagccttcgtgtctggtaattccggggaattaccgctgacggattccggcagatattaatgatgatgaagtagtccatacatacactttggccgctatcgtgctggcagtattgttttacagcatgcggaatgttcccagtaactgttttcaaccatggaggccctttaggaggacggattcctgttttccatggacgattttgggagtgggtattcctcactcaatatgttaaaggacattcctgtcgatattgtaaagttcgatttacgatttctggatgggagcgtaaaggggaacaggcggggcggagtattttatagaatatcatccaactgatgaaggacctgcaggttaccgttcttgcagaaggggtggagacggaagaacagatgaaattcttgcgtgaagtgggctgccattacgcccagggatattcctatgcccggccaatgatgcttgagaaagcggaaaacctattgatggaagagcatgggcacagggacgatgtaccatggggggagggaaaaatgagacgtttaccaacagttaactatatcataagatggcagcggatactaagtaataaatggctgcagtcatggagtgggagcggatagcagaggtaaaggatgttaagccggataaatgataagacataccaggaaatatttatttactaaggagaatggatttatgagaaatttgaaaatagggaaaaaactatccatcacattcggaattatcattgttctttttttgatttcacttatagtttcgtttgtcagtttaaacaattcgggaaataactttaaggatttttatacggtaggatatccggtttcgaataagacaacggatatgcgccgtgctacccagacaggcttgaaatgcatagccctcagtatgcttacggatgatgttgcggagacccagagctatattgaccaggccaatgaacagcttgactccctggcaccaggatttacatttttaaaacagaatttccggggagatacatccgtgctggaccaggcgcagaaatgtctggatgaggccaagccatacagggaacagattattgatctggcagggaagaacaggaatgcggaagcagcagaactgctgtttgataaataccagccattaatgcttaagttcagggatttgatgggcgaggccgattctgccacgacagagattgccgaacaggactataatcagtcggtcagggcccagaatactgcccttgtatttttacttgtgattgcagggctggccttgacacttaccgttatccttgcagtctacatcaccaaagccctgtctaagcccataagcgaaattgaggatgctgctaagaaaatggctgcaggagatttggaggtatcaatcaattacgtttcaaaggatgagttaggaagcctctccgaaagcatgcggattctgactcacaatttcaaggggattatccaggatatggggatggggctgaccgccttgggcaatggtgatttcagtgtggattcccaggccaaagagctttatgtaggcgaattcacgcagttggccacatccatgtatcagattattgacaagctttcatccgtactgggtcagattaaccagtctgccgaccaggttgcttctggcagcgaccaggttgcttctggttcacaggcactttcccagggtgcaacagagcaggcatcctccgtggaagaactggcggcaaccatcaacgaaatctccaatcaggttaagtccaacgcagataatgcacagcatgccaaccggatggcagatgatgtgggacgtaagatgaccgagagcaaccagcagatgcagaccatgattgaagccatgaaggaaatcagcagttcctccagtgaaatagggaaaatcatcaagacaattgaggacattgcgttccagaccaatatcctcgccctgaatgcggcggttgaggcggcccgtgcaggggaagcaggaaaaggttttgctgtggttgcggacgaggtccggaaccttgccagtaaatcagcggaggcttccaagaatacggcggcactgattgagagttccattgttgcagtggaaaaaggtaccaggattgcagatgagacggcccatacactgttagagagcgtggagggcgcccagcaggtaaccaaaaccattgaccagatatccagggcatctgaagagcaggcatcttcgattagccaggtaactcagggaattgaccagatttccaatgtggtgcagaccaattccgctaccgcggaagaatcggcggcggccagtgaggagctgtcagggcaggcacagatcctaaaaggtttaatcagtcagttcaaattaaaggattcaaggaatgaaaccgcatcatctgtgcaggatatgccgaggcagcccatgcagattcctgcattttcagacggaagcaagtattaaatatatgtttggacagaattcggatttaaaaatcgtatgtttcaatcggaagtgtaatctgatatatgattaaaagatggctcctttttggtaagaattcagatatgacgattcttatggaaaaggggcattttttatggttgcggttaaggtgcagatacgacaggttatttttttagctaaaagacagtataaactattataaaccagccttttgtgccgataaaagtaaatggaccctttgcaaagaaaagggattgtgggaagcagggaaaaataatgcagtgaaatagttacatagccttaaatggctatggggattgaagttaacacatatgtaagagatttccgtgcaatgaatgaaccgccgtttttacatagccaggatggcatatgaggattgaaggactacacagtttacatcaggaatgagaacatttttatattatatgagctgtacttatgattaaacctgcttttccacgttccagccatgcctagattgtagatatcccacccttaccggtgtatgggatgggaatgaggtgattttttgagtgataaaaaaatgattcctcctcagggacggaacatgcccagggtatgctatgaggtaaggggacggtatgcactgtttacggaccccatgaccaaaaccggcggggatctgcattcatatccggttcccacttattccgccgttacaggattgacggaaagcatttactggaagccgtccattaagtggaaaccgttgcggatccggattttaaatcctatccagtatcagtcaaggagtaagcttctgcctgtttttaagacaggcggaaaggatttggcctattacagctatctaagtgatgtatgttaccagattgaagttgaactggcctggggcagtgaccggtatgctttggaccgcaatgtggctaagcatcatgaatccatgctgcgatggctcaggcggggaggaaagctgcctgtttacctggggactaccgaatgtttcgcatatgtcaggccatgtacctttggagccgggtcaggatattatgattctgtggatatggactttggaatcatggtccacagcagggattttgaaaagagggaggtccgtctggcgccttacaggatgcatcagggcgtaatccggttcccggaccaggaaggatgcattaccaggaagtgcagggcaggaggggatttgtaaatgaatatgatgcaaagcctggccggcgtgtatgatgctcagtcctccttggccggcgtcaagagggaggatacggatgcggtgcttcttccgctgttccatacatccctggctgcgcagataaccgtgacaattgatatgcagggggattttatagatgcgcaggccttggatttcagggaagatgaggtgtatacgattattccttccacagtggattcggccagccggtccggtccggaaccgcctcctaatccattaaatgacaagttgatttatctgatgggagatggggattcctatatacaggacgaaagggcagctgcggatatccggaaacggtgcagggcccatgaacagcagcttgccgcatgggcatccagtccatatgcggttcctcaggtaaaagcggtcagagcctatctgaaccggaaacggattgcctccgacctgattgcggtaaaggtcatcctgcctgaggaagatggaaccattgatgggaaaaagaaaatagcggatagggatattctgtcctgtgtggtcagattcaaggtagtggataccgaggcaggggatggatatgtggcggagacatggaagaaccgggaactgtttcaaagctggatatcctactacactgcttttgtaatggagaatgggaagaaagatgtatgctatgtaacgggagagtatacggtctgtgccggcaagcatgccaatggcatcagagggagcgcggattgggccaagcttatttcctccaatgaaaacggcaatgttgttttctcgggagattggttttgccagggggatgacgcggtgacaattggcatgctcacaagctataaggcccattgtgccttaagctggatgattaaacgccagggatatgtatttggcagcaatatccgggtgtgctgggatccggatggcaatcccctggcgcttaatctgtttgcagatacagctgaaatcctggggaaacacgaatatagattttttgccggaaggaaagcttatgaaagttatctggatgtgtgcttttcaggattccttctggatgataaagaatatcatatgctggtgctggatgcgcccaataagcaggaccataaaggcaggctggcaattctcgattatgcggaaatgccggcaggccttatctatcagcggattaagcaatggcatcggactgcctgttggcagtttgtgatgaaaaacaggacatttaccggcgctccttcagtggaagatgtggtgactgccgcatatggaacggaatatgggggaggatttgcggtaatggacagtaccttatctgcacgtcaggccaaccgtgtggtgtctgtcatattatcaggcgggtccatgccttcagacattgtggaaaaactagtcaaacgggcgggagacccctgccgttatcatgaatacaatcattggctgctggtcctgcaggttacatgtgctgtccttaaccgtgatgtgataagaggagatatcatgttagacagattaaataaggaccgcagctatctttggggccggctcctggctgttgctgattacctggaaaggctgtatttcaatgaggtcagggaagggcgcttgacaggagtatgcagatatatgcagatgttctcccgctcaccggaaagatattggggggttatccgtaaaagactggttccataccttaaaaaggccagcaggctgaaatacggattgtatgcgtgtaagctcatggaccagatgacagacatgcttttaggccaggcggattcggacgagccgctgggggctgcttacctgacaggtttcagttcccagcagctatgttttttacggatggattacgcagtcaggaaggggaagggatagacttatgaaaaggcaggatttcattatggtattcaaggtggaaaatgcaaacccgaacggggatccattggaggggaaccgcccaaggaccaacgacaatgggtatggggaaataacaggagagtgcatccgccgaaaaatacgtaaccggttcatccacatggggcagcccgtattcgtccagtccgacagcctttgcgtggatggatacagttccctggcggaacgcctggctgcaagaaaggacatttttaatgcactcaaggatgggaagacacagaaagagggtatacgccttgcctgtgaaacatggctggatgtacggctgtttggacagatatttgcttttcttggtgtcaagaccatgaatgcttctgttcgcggcgccgttaccatatgccatgggacgtccgtagagccggtgactatcaaggatatccatatcaccaagagtacaaatggccggaataaaggcggtgtacaggaaaaatcctctgataccatgggttctaagagtgtggtggaacaggcattgtatgtggtaaaaggttcggtcaatccattttattcagataagaatggggtgtgcggggaggatgtggaggtattgaagacagcccttgccactatttttgaaaatgatgagtcctgcgccaggccggctggttccatggcagtgtgcaatttgtactggtttgaacagccggagaatggtgcatgtgtgccagtctataaaatctttgaattgctggatgtccaaaaccagggcggccggtatgcctgccgcttaaaggatgtgccggaaggggtacgggtgacggaactggtttaggtttatgcggatgaatcattatattttgccgaaatgcgccgatataagtacataggtaaacagaaagggacggattacatatgaaaaaggtgattacatatggcacgttcgacctgttccatgaggggcattataaattactggagcgtgccagggcgttgggggattatctgattgtaggtgtgaccacggaacattttgatgagataagaggcaaggtcaatgtgatagattccatactggaacgcattgacaatgtaaggcagaccggatttgcagatgaaatcatcatagaggaccatgaaggacagaagattgaggatatccagcgttacggtgtggacacctttacggttggttctgactgggtgggaacctttgattacctgaaagcattctgtaacgtggtatatctggaacggaccccggatgtctcgtccacacagctgcgggagagccgtttcaggattgtgaagacaggtatcatcggtacagggcgcattgcccccaggtttgtggccgaagctaagtttgtcagcggaatcaacatcatatgtgcgtataatccggagaaggagagcgcccaggcttttacaaggaaatgtgggattaaatgttacacaagggattatggggcatttcttgacaaggtggacgcagtgtacattgcatcgcctcatgagacacactacgattacgcgaagcgggccctagaacaaggggtccatgtgttgtgtgagaaacccatgacctttacagagacggagaccgtggagttatatcagctggccagggagaagcgctgtgttctgatggaaggtatcaaagcagcctactgtcctggcttccagcagttaatcaatgttgcgaaaagtgggaagattggggagatacgcgacgtggaagcctgcttttccaggatagcggacacaactgccagggagatgacagatgagaattacggaggcgcattcctggaatttggcggatatgcgctgcttccggtcatcaagcttctgggaacagactttgaggatataaggatagacagcataccggcggaaaacggcattgacctttacactaagattcagtttaaatataaaaacggcctggggcttgccaaggccggcgtgggcgtcaagtccgagggccagttggtggtggcgggcacaaagggatacatcctggcccagtcgccatggtggctgaccaaacggtttgagatacgctatgaggacccaacggtaatagaacggtttgagcccaacttccagggagatggactgcggtatgaaatcagtgaattcgtgtccaagattaataacccggatttatgccatttcaaactgacgcctgaggagtgcactgccatggccagggtgaccgaggcgtttatggggcagaggagagggtggtgggagaagcgggaacgggcgggattagggattgcgtcaatggtaataccagcttcagggattacttcagtggcggcatcagaaatgacattagtaaggcaggtagcgaaggtatgataagaggaatacggtattgtgccgggatggacatatggcaggttgaggatgcagggattggcctggtggaatatgtgtttggacgggaactggaaggggaaaaccaacaggcgggaattcttttgaccacaggctggataaccggactatccatctcatttactgatgtggaagatggaaagtttccagaggctcttgacagggcctccgggttaaatgcttcttatctggtaatagaaacagctggagccaggggcgggatggacatatgccggattctgatggattacctggaaaaaataaagctggccggagtgaagatatatatcgaaaatggatatagccgcaaaaatgattccctctatgaccaaataacagggaatacatattctgaggcgtccttcctggcaggaatagtggaccggttgaatcgggaaacagggacagggtgttttgggatctgcctcaacacaggacatgggaacctgcttagaaggaacctgtgtgggatgattgaatatctgggccggcggattggtctcgttcatgccaccgatcatgatggaaacagcagccagtgccagatgccgtatacattcacgaaagggagaggggaactgacaacagactggtacggtatcataggtgccttggcaatgactggctttaagggggcggttgtatatgatattaccggtcttttggaagtttcacctgcctgtctgcatcctggctggtacaggctgttatcctctgttgcgttggaatgggaaaatattcttgaacttgaggtatttttaaaggaaaccttacaagtggattttaatgaagccgggaagagggggggaccggtcctcttcggtgcagggagaatgttccttaattatatggatgtatggggggatgcatacccgccgtcttttattgttgataacaacgaaaagctgtggggaagtatgctgaggggcatctgcatccggcctccgtctgcacttttagggtgcaaaggacatcctcccttagtcttaatctgcaatatgtatcatgtaagtattgaaaaacagttaaaggccatgggaataagatggcgcaggtatgatgataagtattttttcagatatcaggattttggccggaaacagggagtagacgtatgttgaagataggggtacagtccaaaggaatcctggacagtgaaagactgaatctggcggatgggttcgaacagattaagaatgccggatttgactgcattgatttaaacctggatgtattcctgaaaaattcagagctttaccagggagagatgaaccagttctttgagcaggatacgggagcactgagacaatatttcactccctatgaccaaggggcaaaaaggttcggccttacctattcccagatgcatgcaccatatccggtatgggttcagggaagggatgtgcagaactgtcacatgataggaaacgtgattcccagatgtctggaaatagccggatttctggggattccttacgttgtaatccatccctttaagatgcagtacagacaggcctgcaaggaagaagggagacagaacctgaagtttttccagggtttgattgaaacagccagggagaaccatgtgataatctgcctggaaaacctctatgaatccattggcggccgactggtggagggagtatgctccgcaccggaggaagtcatatggtatattgacagcctgaaccaggctgcaggggaggaacggtttggattctgtctggacaccggacatttaaatctggtgagacggtctccttatgaaacagtccaaaggctggggaacaggattaaggtccttcatctccatgaaaatgacgggatggacgatctgcatcagattccttacacattcggaagaaaagcaggggatggatttgactgggagggactgcttgcggggcttcgggagacaggatatgatggagtgttgaattttgagacatttccttccatgaacagctttccggatagcgtgaaaatggatgtgctcaagacaattgccggaatagggagatactttgccggccagattggagcggatgggcaggcatgaatggaaaacatggacggaagatgggatggaagggatggcaggcggtatgctacatgcaaagggacaaggtaaaaggacgcagagggcaggcgttatcggtacggggaggattgccggccgttttatgccggaagtatgtctggtaagcggtatccgtgtacagggtgtttataatcctcaccgggaaagcgctgaacggtttgcctccaggtgggggattgaggcatatggggatttaacatcattctttcaggggattgaccttgtatatgtggcttcccctcatgaaacacattattcctatattaaggcagcccttaggcagggaaagcatgtactgtgtgaaaagcctcttgtccttaagcggagtcaggctgaagagctgtttgcttatgccggggcacatggattggtattattggaagggataaagacggccttctgccctggttttgggaaactgctggaactggcacgcagcggagctattgggaacatacgttatgtggatgcctgttttaccaagctggaatccgcagagagcagggaactgaatgacaggacctatgggggaagctttacggagcttggaagctattgcctgcttccggttataaagttattgggaaatggatttgaagacatacggtttgaatccataaaaggagataatgggctggatgtatttacaacggcatccttccggtatcctggcggactggcggcagtggtctgcggtttgggcgtaaaggcagaaggaaggctgatgatagccggtactaacggatatgtcatagcacaggcgccgtggtggaaaaccacggatatggaagtgcattatgaaaatccgctggaagtggataaggtttcagagccgtttcagggggatgggctgcgctatgagatacaggcttttttaaatatggtgaataaaaagggggactggggattgggcagctcctatgggatgcgtgaggattatggagtgcatggatttggaatgacaccggaggattccattactttggcggatatcatggggagattcatggaaaaggagggcagggaccaaggttgaatctggagaggttggaggaactggggattacggatgttgaaaagacgaaaaattaaggtcatagtattatcttttgtcgattcatgccgataaccatatatatacttctaaatactaatattttttaaaagtgtactatatcagagccatgggaatcagctggttgaggtgctgcctgcaaaggacattagcagggagtgcggccgttgccatatttaaagcaggttaagaggataagaagcaatgaggaaagcgcagaagaagaaagccgaggactttatagagctgttagggcaggcccatgaggaaatccgcaaggcggtagagtcaaagaaagatggaattgccatggatttactggggcaatgccaggagggcgtcattgagttagggaagctgattgaaggggcggaaggggaaggattcatgaccattccgtatctggaggattattgtaagctgacctattggatatatcgggagattgaagacggagggagtggcgttgacgcagataaagcctatgaacggcttcagatgtcactcgtccccattggggccagtataaaaaatgatataaaagtcaggttggaaattctattccttccttataaagcgtctatgtgggattcgttagagagtgtctggatggcggcagacgctgacccggactgtgatgcatatgtgatgcccattccttattatgagcgcaatgcagacggctcttttgggacatgccattacgaaggcggggaactgccggattatgtcccggtaacacattatgagtcttactctttggaaaaaagacaaccggatatcatatatatccataatccatacgaccatgggaattatgtgacaagcgtggatccaatctattattccagccatttgaaaaaatacacaagcgaattaatatatataccgtattatgcgacggctggcgatatgagtgaagggcagtccctgtgtccggcctatcacaatgcggattatattgtggtacaggcggaaaaatacaaacaatttttcagccaggccataccgcgggaaaagatactgccattaggttcgccgaagtttgacaggattctccggctgtgtgggaatccgccggaacctcctgtggagtgggaggcggatatggctggaaaaaaggtgtatttttataataccagcattaacggcatgctgtcagatacaaaacgatttttattaaaaatggaatatgtattcaagtgtttccgaggaagaaaggatgcctgccttttgtggcgcccccatcctttgatggaaactaccttcctgtccatgaggaaggggtacaaaccattttatgatgaattgaagcgcactttcatacaggagcaccttggaatttacgatgatactccggatattgagaaaacgattgcgctttgtgacgcctatgtgggggatgcgggaaccagcgtgacttccatgttcggtattgcaggaaagcctgtgttcatattgaataacttaatcaatacattgcccgaagcggatgactggcgtggcgggattatcaatggctttttcttcgatggtccggacgaatggatggtaacacagggaaataagctctaccattcgccagactgtgattatcattatgaattttactgcgatttatctgaatatacgtctggtgattattatctccgggcagtggagatgaatggaaggatatatgtatgtcccgcgaacgcccaggatatcctggttgtctctgaccataagataattgagaagattgcgctgaaacgttataccggacagcggggggcgttttgtaatgcgtggaggattggtagatacctcttcctgattccttttaaatatccggctattgtccgctatgatacagaaaacggcggggtggattacatcacgggatataatgatattttcatcaaacatgcacagggggagtggaggattggcgggagctgtgtatggaagggaaggctgctgcttgcctcgccagctgatgacaaggttctcgtaatcgacagtgcagggatggaggcaagggtgcttacaacaggcagcgccagcggatgtggctgtataggcatgattacttatgcaggtggaatctgtatgcttccatatgcaggtataacggtcggttgctggaatccggataccggggagctgaccgaatatacggatataccggagggattccaatgtaaggacagattatccggccttcctagttcagaacatccgtttgggtacccagcggtttaccagaatgagatagtcctgccgccagtatgtgggaacatgttcctgtcaattgacatgggagctggaaccatacaggagtgggagcctcccttcacggtttcatgggaaggacggaatggatatttcccagtggggatggtaggggtgttcttgaggaggacggatacattggggaaggggacatatcgttttttctatgaaccggaacgaaagctgtatgatatcaatatcaggaccaaggaatttaaggaaataggaattatgttcgacttggatgaactgcttggacacgaaccgggttttggtcgaaactcagactggttcaaatacggttgtgtggaaaatgcgctgtattcgttaaaggattttctggatggaaccgataaaggccatccctttaaccgggaagagcagttgaaggcttacagggaaattgcggaaaatagtgatggaacctgtggaaaaaggatacatgcgtttgcgtgcgcaaacgtgtgaaaaccagaggttccgtgacgccgttgcaacggtggatataagggagcgttttatgatggcgggagggaagaggcattgaagatatgggcgcataggggctgcagccagaattatccggaaaatacgatacttgcgtttgaaaaggcagcgggactgaaaaacctggaaggtatcgagctggatatccagcttacaaaggatggtcagatggttgtggtccatgatgagagggcagaccgcaccacggatggaaccggatatatccgggattatacattggcgcaattaaagaggctgaggatagacgcggggcctctcccttgccaggcaataccgacaatggaggaagtatttgacctgttggaagaccgtctgagagctggactgaagcttaatattgaattgaagaacagtatctgtccatatgagggcatggaagaaaagattgtggctatggcgcgtaaaaggggcttaacgggcgcggtcatatattcaaccttttatgccaggtcactggaaaaaatcaggatgcttgatccggacgcggagcttggaatattggatacaaaggcatcggactgtctgtataagctgaagggcgggtgcggggccaaggcgttgcacccattctggaggtcaatggatctgccggcagaggaactaaaggggtatagggtgcgggcatggatgtcagggcatctgtacccggagcggcctacgggtacaaggctggatttaatgaggcttgaggcgcaggggattacggatgtgttcctgaatgagccggaggaataccttggataaattataaataagcaggaggcgggcgtcatggataagaagcgggaagcggttatatggggagccggaacgtatgggaagatactattggaggtatgtcgtgaattggacggattccatataaccgcattttatgatatcaatgcagatatacagcaaacgtatataaatggaatagaggtttatacagaagaaaagtttgtgcgctacatgaaagaccatccggaagcgattgtcatcataggggtgatacatactgaagcagttaatgagataaaaagagggatggaagaatacggcttaacagaaaaccggaccatgaatcaaagagacatcgcaagagaatatagggaatacattaaaaacaaagggcttccaaataaatatgaaattgattatgaaggacagatagcagtatgggttgataacctgatggaagaagtgggtttttggtgcaatgaggtggcgaaaaaacagaagggaagttatgccggtcaaatgcgggctgaacagttttcatgtgatagggtaatgtcaattgttaaagaaaacgacattgttattgatgttggctgtgggttagtacctcaatatggcatggagcttcctgggggtgggggagtggaactgctgtcgatagatccacttgccccattttataaccagataaatcaaaagtatgcggataaagccccggagattaggtttggattgtttgagttcctgtcaaaaagcctaaaaaaaggatatgcagatatcatcctggtggataatgcgttagaccactgcattgatccattcatgagtatccttcaatgcttgtgtgttttaaagcctggaggttgtctttctttaaagcacattagtaataacgcggtgtacgaattatatcaggggttacacagatggaatttagactgtgaacaaggcgattttattatttggaatcaggagaattatataaatgtgtccaaaagattggaagggtcggtaaggattgatgtgaaacaggataaggagtcccttcagggctggaataatattgtcgtaaatttaacaccttcagaaaaatataggctggaagattttatcagcccaagccaggaagggcatcagatggcagtaattatcaaacatttatttgaatggatggctgattcggagaataacagggtgtttaggaagatgctgtaatctgtcttcggatttaacatatggggttccattcagcaaagtgcgtgatggatggtgtggaagccctctaaaagccggtagtcctacaagctaataaagaataagcataaaactaaggtggtaacattggatgcttaaaacggaaaaccagagacatgtgttgacagagacagaattaaaacggttacagggtatagaattggaattattagtggaatttgataggatttgccgaaagcatggtattatatacagcatcgatggcggtacacttttgggagcggtgcggcacgggggatttatcccatgggatgatgatgcagatgttatcatggttcgctttgaatatgagaaattcaggtcagttgtaaacaaagaattaaataaagacaaattttattttcaagatatggataatacccctggataccgatgggggtatggaaaactgcgccgaaataattcaagttttattcgattgaatcaagagcatatgccatatgagcaaggaattttcatggatatatttgtatgtgataatgttccggataattattatataagaagtatatgcaatttcataagttttatatatagaaaatttttttggtcaaagattggaatggagacggaaagaggaataaaaaaatatctgtattggattatggcaaagataccggaaaaaagacttaaatatagttaccgtaaatatgtaagatatagaaataaaaaaatgtcaaattgggtaaaatgtctgacattcccggcatgtaataaaagctatggttataagagggaatggtatgaagatacaatcgatataccttttgaaaatgtaatcttaaaaggcagcagaaaaaaagaagagtatttgcattttttgtatggggatttcatgtcgctgcctcccattgaaaaacgaaaagtacatcctgtttcaaaaatagaatttccttttgctgggggtataacaaatgaataagataatgtttgatttattaatgtatatggaaaatggagagcaatggaatagcagagagattgctaaggaactttataagccttattccataatagatacagaactggctaatttgattcaggaaggatatatagagaatggaatccttacaacgaaaggaaaggattatttacagaatcatagggtaacaaatgccataattttggcagcaggtgtttcttcaaggtttgttcctttatgttttgagaaacccaagggtattctacccgtaaagggagaggtgatgattgagcggcaaatccgtcagcttcacgaggttggcataaatgatattactgtggttgtgggatttatgaaggaacagtttgtctatcttcaacaaaaatatggagtaaatattatcgaaacaaatgattttaaaattcggaacaaccatgcaagtgtgtgggctgcaagggagaggctgggcaacaccatcataacatcttcggatctatactttaacaaaaatatcttccaaaaatatgcttatgatgcatattattgcacaatctacaaagaaggaaaaacggaagaaagaggcatcaaaacggatgcttatgacaggattctggaaacgcgatatggtgtggcagactcatgggtaactctgggctatgcttattttaacaagcggttttcagataatttcattaaaatccttaccgatgaatttgacagaccagagacagtaaacaagttttgggcagatattcaggatgaacatttgtccgagctatatatgtacgcaaagcgggttgataataatattatttacgagtttgattatttggaggaattaagagattttgatgaagtttatttgtcagattccggatcatccctgatgcgaaaaattgcaacggctttaaatacggcagagaagaacttatcaaaatttacacctatcacaaaagaagacctaagtaaaggattcacattttcttttgaacagagaaagtacatatgcaaaattgacgataatcttgaggtgactgaaatacgcagatatgatgataagctacaggaattagttaatattactgagagctttacaacctattatcatgatacactgcctttatgtgctgcggaaaatgtcatttctgattttgggaacatgcctttatccatgggctttcaggaacgctatattgtaggtaatacatattcatatctagaggataataattttatcggaagtacctatctcttaccattttatgaaatgatttctgaagaatgccagacaatctttggagcaaaatatacagattccagaaccctgacaggaatgaattgtctgatgattgttttgatgtcgttggcgaagaacggtgacagtgtcatgattttagggagcgcaagtggtggacacgcatcggtgaaaccgatttgtgagaggttaggcctggttgttaaggaagtgccatatgattataagaactttgatttagattatacgaaacttaattatatattatcagaagagaaaactgattatatacttttggcgccatctgatattataagtcctttagacatcggaaaaattaatttgagacagaccgtccttttatatgatgtaagtcagatgctgggacttattggagcaggactgattgataatccattgaatataactgacaatatagttatgtttggtggcacgcataagaccttccccggaccagcatgtggacttatcatgacgaacaatgatttcctgcatgaaagattggagacaacaattaatccgatttatatcaggcatactcagatgcatcaaaaggtaagcctgttatttacattggtagagtttgaaaattttggtcatgcttatcaggaacatattgtggcattggcgaatgaacttggcagaagtttatgggaattgggaatggatgttgccaaaaaagatggcagatattccagaacacaccaggtatttatacggacagataagaaaacaatggattgtatttttgataatagtgtaaaatatgggattactttaaataaaaaaagtaaggagttgttttctggttatggaatacgcttgggaactcaggaaatcgccagatataattggccgctagagtctatgaagaatgtagcgcagataattaagactatttcagaagaaaacataaacattgaaaagcttactgcattgattaatggactgccggaaaagaagatacagtttacatttgatgaaagtgcagcaaattatttccgtaagtatttataaattcatagaaagaagaggaacgtgtttatggatgtattacttagcattattgttccaatttatagagttgaagaatatttgcggcaatgcattgacagcattatcagtcaaacatataagaggttggagatactcctgattgatgacggctctgacgataactgcccttttatttgtgatgaatatgcgagaatagataaaaggataaaagtgattcacaaaacgaatggggggttagatagtgcccgtaaagcgggagttatggctgctacaggtaaatatgtggggtatgtggacggcgatgattgggttgaaccacaaatgtttgagaggctggtatacttagctgaaaagcataaggtaagcgttatagagtcaggaataatagatacagcaggcgattatacttatgtcaggacatcaaggcaaaaagaaggagtttatataggggaagattttgaaagggaaattgaaccttatgtgttgtatgggggggagttttttgaatatggaataaccgccagtttatggaataaaatattcgaaagggaattaataaggaagtaccagatgttacctgaattaactgcacatttattggatgatttaatgtgttcccttccatgtattgtggatgcaaaatcaatttgcattacatacgaggcattttatcactatagagtaagaaataattcatataaatataccataagaagggatatagccgaaatagtcaggagatgttatcctggatggattgaacgtttttctgctgcaaaaaaggcatcccgcatagataaacaaatggagtatgttgcgatgtatcttttgctgatgaaagcaatctatgtatttgatgatacaaaggatgggaacatacttactccgtttggcggtattgagggaaataagaaaattgtattatatggagctggtgcaacaggaatatatatatatgactatttagtaaaacagcaggggatgaatgtaatatgggttgataagaatcacaaaaatctgcaaagtaatttgccagttatctcacccgacgccattaaagagtttgattttgattatattgtaatatctgtattatgggcttcaaaagtcaatgatataaagagagaactaattgaatttggtgtgtctgatagaaaaatcagatggatttgtgataaatatatttcagagccacaattgctgctaaaaaaagctcgaattaaaggtattgctatttttccacgattacaaaattgacaaataggagattaggattatggatgtacgaagatgctttccttgtgatgaaaaagtggataataaaagctttgagagcaggatagagcggatatatcatgctttgttagatgaaaagtcccaatatattttttcttgtagaatgatgtatagccttacaaaggattataaatatatctcgaaaattttagcaaaaactgatgcaggtagacaattttctgaaaaattagattcggttattaatgaagttggtttttttaatggaacaggtattgattggtgtgggtctggggagtttggtgattgtttggttggggatgggcagggggcgttaatatatggtgccggtattaaaggtacccgtcttgtccaacttttcccggagaagaattggaaggggtatattgatcgatataggagaggaatattaaatgggctcccaattttaggaattaatgagtgtaataatctttctgataaaagtattgtgatatcaaatacaatgaacccctatgatataaaaaatgatttagtaaatgaaggtgtttcagaaaaaaatattattattttaagagaatatgattctattgctggacaaaatatttattttgatgatgcgatactgcggaatgtgaaagaaattaaaggtgcgtttattgatgtgggatgttatgatggcgcagataccataaactatttcaaacgaaccggaaatattaatgcaccagtaattgctattgaagcagatgcaacaaactataatatctgcaagaaaatcttgcaggcttataaaaatgtatctgtaattaatgtaggattatcggacaaaaaagaagttaaaaagtttaatcaaataagtacatcaaactctaaattttccgagagtggaaatgtcgaagtaaaaacagttcctttagatacaattgtagagaagcaaagtgttggatttataaagatggatatagaaggttatgaggaaagggctcttaggggagcaatgaaaacaataattgaacaacatccaatattagctattagtatttatcataagcgttctgatatatggaagttgccggaactattacttgaaatgaatccgggatataggttttatttgagacattatacagttggggtgactgatacagtgatttatgcaatcgataaaagaaacttaatagtatagggaatatgaataaaaaaattcagtgattttattttactacagatggagaatacaaggatggtcgatttaatacattgcggaaaaaaagattttgcagaccaagtcaaaaatcgaaaatttgtatgttttggggctggaaagcgcttcttgaagtttttgaaatattgggtatcggaagagaatattaataatatactgtgtgttatcgaccaaaataaagtaaacgaaaagatggaataccttgataaagatataccaatctatagtatggaatatttcattagtaataatcaatgtgatgattttattctaatcataactaatctgtatgattgcatggaaatagtagggactttagatcaatatgccctgtttaatgataagatttgttttatagaatacataatagatgatgggtatcagggacaaacatttaatctcacaacagattctgcttctgaaattgataaaataatacattactgctggtttggggggactgagattccgggaaatctacaaaaatgtattgatagctggaaaaaatattgccccgattataagataattcgatgggatgaaagtaattatgatgtcgcccaaaataggtacatgaaggatgcatatgatgctcaaaaatggggatttgttccggactttgcaagattagatattatttataaccatggggggatttatttagacacagatgtggaattaataaaatcgttagatgtattgagaaagaatgaaatgtattgtgggtttgaggataatcattatgtgaatttaggattaggatttggtgcagttaaaggccatgggttaataaaaaggatgttggatatgtatgacgatttgatttttgatatacgttgtggaaatccaactgcgagtccggtttaccaaacacaagtattgtctgaggaaggcatacaaataaataatacgtttcagaggatggagaatgttacggtatatccttcagaggtactgtcacctatagggtttcgaagaattggaagtggtgtgacacggaatacggtttcaattcaccattatgatgcttcatgggtggaggatagattgaaaaacaaggagaatttgaagaagaataaagacagatattttcagagagccaaaaatgtatttttaaacaaatcttaagagggagaatcatggaaaagtggattggagagtgttctgaagtatataaaatgatgggtgatgatatttcgaggaagatatatgagacacgaattatgtattcgttgacaggggcggatgaatataagtacagattggtgaatgaattttctgtatggaaagatttgcagtgtttattagatggatgcagaaataaaaagcctattttattatatggaattggaatacgtggtaggattctggtggattttggtgaaaaatgggatgcgattatagataattcctctgaatatgaatcaaatgcagagtataaaggaattaaaatatataatacagaagctgctaaaaaaaattatccggatgcagtaattgttgttgcaaatagggagggttttgaggagattcaaaagagtttattagaagtaggatacgagaaggaggacataattaattttgggaaaatgtggaacgattttcgggattcacagtattttagtctggaacagcttccgcatgcagatgacgaggtttttgtagattgcggagcttatgatggtatgacatccgtgcaattttcaaactggtgtcaaggaagatatgaaaaaatcatttgttatgagcctgacactcagaatgtccgaaaatgtgaagaaaatttgaaaagaaatttgactcaaaataaatatattattattccgaaagggaattggagtggtgtggatcaactctttttcaacgaagagggaacggtggcatcaaagattgatcagagaggaacggcagtaattaatgtgacatccattgatgaagatgtaaaaagcggcaagatttcaaagattacatttattaagatggatatagaaggagcagagttcgacgcgctcaaaggggttgaaaaagtgattaaagagcaatctcctaaactgggaatttctgtataccataaaagagatgatatatttaaaatcccggctttaattagacagttcaatccgagctatactttttacttaagacattactatttagatgatacagatacagttttatttgcggttcccaaaatggaaaagctatgcatcaggtaattattttagggatagatgtttttgaagaatgttaaagttagggagcagaatagaatgttaaagttaggagtggtagttcctgtttataatgcggaaaagtatttggataagtgtatttccagcattataggccaaacgtatggcaatatggaaattgtactggtggatgatgggtcaactgatggaagtggaacgatatgcgataagtacgcagaaagagacagtaggatacatgtgatacatcagaaaaatcaaggaaaacttgcagcaagataccaaggcgttaaaatgcttatgtgtaagtacataacatttgtggatgcggatgattggattgctaaagacctctatgaaaagattgctgtctatatggaacaagatatagatgtcatttcttttgtaattacaagatatttttcagatgattgtatagtggagtcaaaagataaatataccgttggagaatatggaattgggagattggcaagcgagattttaccatctatgatatgggattacgacaggacacggtttggattggacccatctctttgtaataaaattttcaaaagaaatcttcttttatcacagctaagagcggtacagaagattaatgtatcgtacggagatgatatggctgtaatatatccgttgatgttagaagctgaaagtcttatgattacagattgcggattatattatcatcggcaaagaaacagatgtgaagttgcaccatattatgaagatgatttattttttgataaaatactaatactttatcattatctgaaagaacgcatgggcgatgttcccttatttgttaagcaattagactatatgttggttagtgagattagaggcaggctcagaaaatatggaaattatccaaagaggatgtatttattcccgtttaatcaagttaaagctaatcaaagtattattctgtacggtgcaggggcagttggacaagcatattataaacaaatcaaggaattgacttatgccaatattgtggcatgggtagataaaaattgcagacaatatgaagatttagaagttgaaggtgtagaagtcataaggaacattaaggaatatgattatattgtaattgcggtagaaaatgaaaaggctgcgtgtcagattacagataatctggttaatgagatgaaaatcgaaagagagagaattatttggaaaatatattatggtaactaagcattatctgtcacgggaaaacatagatggaagaaaaatgtatgagtgccgcagctatgctgaacgatttttcgttggaagtccataataggcgaaataaaacggaggaatcatgaaattttcaattgttgttcctgtatataacgtagaaccatttttaggggattgtttggaaagtattttgacacaaaactatgatgattatgaagtcatctgcgttaatgatgcatcgacagataattccttggtaattctacaggactttataaaaatgaataaaaagattagattaataaataattccgttaatagaggactgtccttcagcagaaattgcggtatcaggaatgcttcagggaaatatattttgtttgtggattcagatgatattctgtgccaaggggcacttaagaaactgtcagaagaggcggaccggtatgatacagatatcatctattttaatatgatggtaaaaaatgaaggacagtgggcgaaagagaaagggggtccgcaaaaaaaacattataaatatgaagggacatacacaggacaggaattgtttgttaaactgtaccaaaatgatcagataatagttgaagtatggcgtcaactgttcttaaaaaagtttatagatgagaataatctgtatttctatgaagggatagtgcatgaggatgctctcttttccgttatttgtgcgatgaaagccagacaggtatcatatcttgaacaggaattatatatatacagaagacgggatggctctataatgtcgaagttgtctgctaatagaatggaatcttgttttattgtgctcatagagttatggaatttttggtatagtaacacattttcggcagaggtaaatgaagcgcttggcagatatttgaaaatgttattccatcagtttaggtatatgagatgttatttcccggaggttaatacaatatcttatggcgggcccgcagaacaatttatgtttactatgttgacctcagatgattgcgctcatattaaatcttcttatttatcaagcgctcagttaaagtacataaaaactgctgagaaggtaattgtatatggtgcgggaagagtcggaatagaagtaatccatttgctgcgtttggaaaatattgaggcagatgttgttgctgtttctaataagcatataaatccagacaatgtattgggtataaagattgaacagattgatgaattaacaggcttagaacatgccgtaatcatagcagcggttactgaaaaatatcgcggagaagtttcaaacaaactaaagcagctagggatgctggataatgtgatttttttacaaccaaaggatgctgtactgtagcaatatataaaccatgagataatagggacgagtttatggatacagaaagaattatcatatatggaaaaggtagtgtgcttcaaaagaatgcctcactgataaattggaaatctatcatagcagttgtagatatgaaggctgtaccgggggagcagtttttcggtgtgcccgtcattcctccaacggaaattgtaaatctggaatttgactatgtagctattggttctgaaaagttttatgagcagataaagggacgcttgctgggggaatttctggttccgaaagaaaaaattatttcctggaaactccttatctcaccaaagtatatgtttggagatgtatccctagacatcctaagaaaatatattaaaaataataatatcttgagtgtgcttgatataggaatgttggtaatccctgaatatcttttttccaaagaggaattatcagatattgatttacacatagatggaatcggagaaacgatatacccatgttatgatctgatatatggcacgtgttatcggacacttggagcttgtaaagataaatatgatttggcgctcatatggtctgaacaggatataggcgcggtgctgaatgaactccgttggaaggtaaagcatattatgatagtccttccatactttaagaatcagaagaaacagggagatttaaatcagcagatagagcaatatggggaattaaagcatttttctactgtggatgggcaaatttggattcttgattgtacagatatggtgaaaaaagatatggattccccaatctatgtggttacccacaaaaaatatggtgttatacaagataagccctacattccaatttgtgtaggcaatgcatataaaaatgatgattttctgtctgaatctgtgggggataatatatcacatttaaatataaagataaatgaatgcactgcaatttattggatatggaaaaatacatgttcaccatatgtaggtataaatcattatcgcagatatttttataacgatgatattatgaattcaggaaacttcctggatagccatcacatccatgccattatgcaggagtatgacatgattgtgcccatggctgtaagaagtgaattttgtacatgcatggaaataattcagaattcgattgataaggatgcctttgaaaatgggaggacaatattgagaaacattatgttggaaaggcagccagcatatgttacggtatttgacgatgtaatgaatgggcataaagggatattactgaatatgtttgtgatgaaaagggagatttttaatgagtactgtcaatggcttttttcatttttgatagaggcagctgaaaaaatcgaggtagacaaatatgatgcatatagtaaaagggtaataggtttttttgcagagcgcatgctgacagtctggctgacaatgcatccatataagatgaaagagctgccggttttgcttctggggtaaggagaggttgttggaaaagattatggaataacaaggagaatgttatagttgaaggacagtaatatggataagaaaatcatttcagtatcagtaatcataaccatccacaacgcagaggcataccttcgggaatgcctggacagcgttgtgaaccaaacttttaaagattttgagattttatgtattgacggcggcagttcagattcctctccggaaatactgcgggaatatgcagcaaaagataccagaatcagaatcataaatgacaacaataccagctatgggcacaagataaatatcgggatggattctgccgtgggagaatatatagcggtggtggagtccgatgatctgctggagccttatatgctggaggaacttcataaaattaccgaaagatattctcctgattttgttaatggggaatatcgttatttttttgatatcggggatgtaaggatattcattccccacacaatgtattgtctccagccataccatcgccttatacataaccataaatgtccaaagaactatgaaatcatggaccgctactggacaggcctttatagaagcgaattcataaaacgaaaccatatccgtctgaatgagtctccaggcgcgtccttccaggatatgtccttccgctttttactcagtatcctggcggatacatgttatcatacggatatacctgtgtatcaataccgtatggataacccgggatcttccatgaaagaccaatcgaaaacggtagtgattgcggatgaacatgattatctggaagaggaattgagaaaaaggagtattacggaaaaagaagtatgggaacagaaatactattggaaatattgtgattttcatggaaatatccaccggcttcagggattaggcaggatggccctttttgaacgatatatggaagaattagaaagggatattgataacatcccggattacagcgaggatagatatccctatgcttcgtggtggattttagaacacaggcaggagtatttgggacagctggatcaggaatatagggcctatgtgcagaagatggagcattttcagaatttgtatcaaagcatcatacgaatcaagcaggtggttatctttggcgcagggaaacatggtgagacggtttaccgtagatacctgaatacctttcaacggtttgtgtgctgttttgctgacaaccgcagggagggcagtagacagatatttggaatacctcttctgtctccaggtgaagcggttaggaaatatggggaagccgtatttgttgtggcaagcagtatatatgggtcggaaatgaagaagcagctcattaatctgggagttgcggaaaaatctatatacagcatatgaggagagaataatgtttggaatatccgaagcagctgatttgattaagatatttgaatcagacaggcccattgttttatatggtgcaggtttttaccttaatcagtttctgacagaactgctcatgatgaatcatagctacataaagaggattgaatgcatcctggtacttgacatgaagggaaacccgtcagatgtaatggggattcctgtaaaaaaatatgacggtcatattctaaccccacagcatgatgtgctgctgaccttgggaaagcgttattttgattcagtatacgggtgtttggaaggtagtggaagccgaatcgtttcaattgactttgatatgtttcagagaaaaccatatcaggaggtttatgcaagtattgaaccctttttgtctgaattcctggagaagcatagggatggaaattataaggaactgaattcttcccgtgcaagaccgggggatttctgcgtgagggcatggagctgctggtggcaaggggaagatgaggcaccagaacttgtgaaagcatgttggaacagccagaggaagaatcttccagaggggattcctcttgtaatcatcaccagggataattttggacagtatattgcactgccggactatatacttgaaaaagtggagagaggaagtattacgctgactacattgtctgatattataagggttaacctgttatataagtttggtggaatctggtttgattcaacactgcttcttacgggggatttgccagtcaaggtttttgattttcctatatacaccaggacccttcctgagacacagtactgtacaaaaacagtctgggcagattggttcatctccgcgacccccggtcatttattgttccggtttgtgtcagatgcttttaattattactattcggtgtatgacagtatacggtattatttcatgatagattacctgattgccatatgttgtaatacattttctggagtgcaggatgatttgatgaatattcctaataataatgaaactgcacttgaattggggagacatctgcaggatgaatttgatgacatggagtataggagactgaccagtggatcctatgtacaaaagctgtcatataaaatcagttggaaaacagatagccggaaagaagatagcatttattggcatgttattaaaaacaatcaataggatacatcttttggtcagggaggatatgaatggaagaaaaagcagacattaatcagatcattgcggatatgcccacagcccttttaagctggtacggctttgagaagcctgggcgtatcctttacatatccggtggggaggaccatctgtcccgttcattaaaggcgcagggcagggatgtatcctgtctgggcatggaagggtccgtgtcggagacattcctgtccggacacttgggaagctttgcttacatcatggccgtccaatgtctggagcaggccgatgatccaaaaaaggtgctgacagcctggcgcatgctcctgtcagaggatgggaccttgctgctgggggtgaataaccgtttggggctgtgttatttctgcggggagcaggatatctataccaaccgcagttttgacggcatagaaaactaccgcagaatccgcatggaagataagcaggatatgatgggcaggatgtatgcaagattcgaatgggagcagatgctgggggacagtggtttttcccataataaatatttttccgtactgccgaagctggaggccccacagctcctttttagtgaaaaaatcctgcctatggaggagctggggatgcgcctgtttcccatgtaccacaatccggatacggtatttttggaagaggagtatctttacacttcccttagtgaaaatgggatgttccatcagatggcgaattcttatttgattgagtgttccttagacggggtatgctcggatgcggatcaggtgacattatccgtggaccgtggaaaagaaagtgcactggcaaccattgtaaaagataacggtcaggtggaaaagaaacctttatatccagaggggataaaaaggctgcaggtactgcatgcacaccacaaggaactggaaagccggggaatccaggtcgtaaagctgggattggatcatggaagctgtgtgatgccctttgtgccgtgtgaggccgggtccctgtatctgaggaaactgttttatagtgatattgaccggttcgttgaaaaaatggatgaattccgggacctgattcttcaatcctccaatttgattcagcgtcatgtaaaggtatctgaactgctggatgaggaaaaaaaggagcttggggaggacggtacggacagggatgaccttggcatggaaatctgcctggaacatgggttcctggacctggttccgctgaacagtttttatgaaaatgacactttcctgttttttgaccaggaattcatggaagaaaacctgccggtgaaggtgctgctgacaagactggtggatctgacataccagggggatgcacggatgccatatatcctgccggcggagtttttcctgaagcgttacggattggaggagcatattgatgtatggagaaggaaagtctggaagtttacggcacggctgcgcaacgagaggcagcttcgcagcttccatgagaagtaccggaggaatgacggcattgtgaactccaaccggcagcgcatgaattattctgcatcagaatataagcggatattcatagatattttcagcggattggaaaataagaaactgttcctgttcggttcgggtaattttgcaaaacagtttactgcatattataaaaatgattataccatatctgccatattggataataatcaggaaaagtgggggcaggatttaaatggaatccccattgtttctcctgaaaccataacacaactggaaccatatcagtataagataatcatatgcatcaaaaattatgtaggcgtcatgaaacagcttaagctgatggggactgttaattatgctgtttatgatacggaagcagagtaccagcgcagacctgcaggaatccctggcattgggataactggcagaaggaagtcggattttgtggaacctgatatggagccaaatggctcaccgggcggtacaggaacaggtgaagtaactgggaaaaaatatcacatcggttatattgcaggtgtatttgacctttatcatatcggtcatctaaatatgtttaaacgtgctaaggaacagtgtgattacctgattgtcggcgttgtgacggatgaaggggtacgcaggaacaagaagacggatcccttcattccatttagtgaacgtatagaactggtacgtgcctgcagatacgtggatgaagcagttgaaatcccgttagattataacacaaccagggatgcttaccgtctgtaccggtttgatgcccaattttcaggcagcgattatgcggacaatccggactggctggctgataagcagtttttagaaaaccatggtgcggaaatggtgttttttccctatacggaaggcaccagctcgtcaaaaataaaggaggtcatcagccggcagttattatgagtggacctgaggaaaaaagatacacgcacatatgatggggattctgcaagaagagacaatttaagaagttttgagaagtacccaggccgccacttaaagttgcggccttttcctgactgtaaaatgaaaagtaaagctttccctggtccgttcatacggttgggagtgtgcttgttggcctgcaacggtattgtaacgtgtgaaagatatatcatgaataaatgcatgaatcatttagattaaaaatcttaagaatcgttcccgtcgttgtcatccgcctgcggatttctgtagtccagcattttctgctgcatatgcagaagttcttttgccatgacaaggaggtagtcctgtgtgtcaggcagcagttgggagaataaatctaaaagttcctttttatgaggagaggatacaaacatttccccttgtccacgtaccaaatattgttcagatacattgaatgtgatacagataatccggacatacgtgtcggataaaggtcgtatgccgttttcaatcatggaataggaagtctgagttattcccaaatattttgcaaattctgtctgtgtgtacccaagggcctttcttacctgctttaaacgctgaagcacaaatttacctcatttctatattacatatagctaattctgcctggcgtcttactgttctcatccgcatggaaaattcttccaccaagcagggggagcatattcctatgataaacctaaaaagcaaatttgaacataccaaatatgattttaagatacacatttataattttttatttacaaacagttgacggagcaaccagcattgcttcaatgtaatacattttaaacgattattttatattatcatatcataggttttataaaattcaaggcttataaatattcatattctatttttattttgtgctcatatccttttattttcaggtaacagatttctcatagatataaaaagaatagatttttttaataatcatgtcatatcttaattgattttttattaatttggtgatattataatataacaaagaaaataaaacatatctgttaagaaccgttttaaggagtgatatgaataatatgcaaaagacaaggtctgaagaaatggctatgattttcaggcagcttgcacctatcaatcagcgatatcttctaatgatggtttatgtggcagatatcgcggaaaagaatgcaagaaaaaagcactgggcacaaatggaaaacaggcagggaaatcatgaggcctgaaaacccggtctatttttacggaaaaggaagttttaaagatgtcaggattatatggaaatggaatcgcacttacggaaaaggtgctggattttttgtgggccagacagagtataacacttaataatatagcgaatgacgatacgcctggattcaagtcacagcatgtctcatttgaagacgaactgatacgtaagttccagggcgtggaaaaaagtcccaatgccccatccgcggtttccaaggctatcgaaggaaccaaggccagacttgagacaacttgggccgaatccagccgtttggatggcaacagcgtggacatggatcaggagcaggtggagctggtccgcgccgcctatgagtatcagcatatggtcagttccattaataatgaaatcacgcgtctgcggaatgctgcaaaggcattttaggaatactggataaaaggggaagggaagcggatatggaaacaggtacatcgtttattacgttaatgaaagcgtgggaaccaatacagaagtcacctgatgtaaaagggggcgcaggctattcgtcagagacacctatattcagggatgtccttcataatgtggtcggtcaggtttattccacacaaagggatgtggagaagaaacaatatcttctggccacaggacaactggatgacgcgcattcacttcccatagcagaggcaaaagccgcgctgagccttgaggtgatgatatccctgcggaataaggccatggaatcatacagcgagctgatgaagatgaatgtctgatttttcatataaacaaaagtaaaaggctggattatcatgcaaaaattaaaagactactggcagaatctatcagacaattcaaaaaaaatgcttatggcaattgcaggagggactgctgcaattgccattattgcggtgttggttcttaaattgggtacgagcacggattacagcaccctgtttacaggccttaacaaggaggaagcccaggaggtggtcgctcttttacaggaagaggggattgactaccggtttaatgataaagatggggcaatccgcgttcctgcggcaggggcagaccagaccagggctgagcttctcgccaagggatatcctaaaagcggttttacatatgatatgtaccgcagtaatgcagggctcatgacaacggagtcagataagaagcagtataccttatatgacttacaggacaggctgggagcgcagatacgcctgtttgaaggggtacaggatgccaaggtgactattgctgaggcagcggaacagaagtatgcccttcaggataatacgaacatggatgcctccgcttccgtggttgttaccatggcggcaggacagagtctgaatgacagcaaggcatcggcaattaagaatctgatagccaggtcggtgagaggactgaatttcaccaatgtggctgtttttgatgcggatacaatgatggaagtgggggggagcagtacaggggaggatgcctttggaagcgccaaggacctggcggccctgaccggactgattgagaataatatcagcatcaatgtgcgccgcgttctggaaaagctgtacggacagggcaatgtggctgtatcggtaaagggaaccctgaatatggagcgtctgatacaggagaatacccggtacagtacgccggagaagataaatgagcaggataaaacaggacttctgaacagggaagacacgctgaatgagaattcggcggcatcggaccagggggctggaggcgtggctggagcagatgccaatgcggatacaccgcgttataccaatcaggctgatacccaggccatagcagacagctacagcaacagcagcgccaccagggaatggctttacgattcggtaaaggaacagcgtcaggtggaccccggggtgctggaaaatgcgacggtgggcattgtgatcaatacagatgataccactacggtgaccaataaccagctgattaacctggtggccgattccgcgggtattccacgggaccaggccagtcagagcatcaccattgtcagggcgccgtcccaggaagtggtgccggtcattgtcccgccggatcagccggggacgctggataaaagtctgccccttcccatcatcatagccatgatagctggcggggttttaatccttctgcttcttttattgctgctcatggagaaaaggcgccgccgcaaaaagacggatgagtatgtggattcacccaatctttacgctgtaggggaagaggccggtggggcggagacggaagttcctgtcaatgtccttaatacggaagccggtatccagatgcaggcagagaatgctgagatggaacgcaatgaggaaatccttaacctcaggatgcagcacagcctgaagctgaaacagaacataggggattttgtggaccagaatccccagatagcagccaagcttgtacagagctggctgaggggggaggtagaggatattgccggaaaccgtagaagaaaagaaagataagacggaagcggccaaggggcctgtggatatcaaaaacatggatacaaagcagaaggcggctattgtggttgtttcccttggggctgacagggcttcccagatttataaatatctgaatgaacaggatattgaggacctgacctatgaggtggccaagatgggaaggaccaccaacagccaggtggagggggcgctggacgagttctataagctctgcctgacccacaagatgatgacggatggcgggcttgattatgccaggaatgttctggagaaggcttttggggagacaacggcaagaagcctgttggaaaaggtgtctaaaacccttcagtccaagccctttaatttctttatgaagggcgatcccaaggccctgctgtcccttctgcagcacgaacgtcctcaggtcatcgcgctgatcatgtcctacatggacccggagcaggcggcccaggtgctggagcagctgcctgaggccaagcggatccccaccctggaagggatggcgaaaatggaccgggtatccccggaagccatcgccattgtggaagaggagatgaagcgcaagtttgccaccatcattaccagcgaggataacatgaacctgggcggtgtggattatgtggcggatatcatgaaccatgtggaccgcaccaatgaaaaacgcatatttgatgaaatggataagattaatcctgacctgtcccagagcatccgcgacaagatgtttgtatttgaaaatatcctggatatggatgaccgttcggtacagcgctttgtccgtgactgtgatccaagggatatcgtatatgcgcttaagagcgcgtccgatgagatgaagcaggtattcttctccaacatgtcaaaacgtatggctgaaaccgtacaggctgacctggagattaccaccaatgtcaggatgaaggatgtggaggaagcgcagcagcgcattgtcaatatcatccggaatctggaggatgctggtgaagtgattatcaagaaggggggagatgatgatgacaacatcatcgtctagctgcatcataaagccgggagcgggaatcgaaatcatgcggtttgtccctccttccgagacggatatggcaccgacaagacaggaaggcggggttaaggggccggagcatgccgggaccggggaaaaccatcccggtcctgccccaagggcggcaggaccggaaacagcggattttgttgggaacgccagggaggaagcccggcagatacttctgaaggccaaccagatggctggggatatcctcagggatgcagggatacaggcagggcagcttaagaaaaacgccatagaggaaggctgcaaggaaggctttgaagcgggatacagaacgggaacagagcaggcggccgcagagcaggctgggtttttcagacagaaggaagaagaattcaggagcggtatggagcaggccctggcatccattgaccgggaaaaggaaaagagtctcaggaactacctggaggaattaaaggattgttccattgccattgctgaaaaggtcatacacatcagccttaggtccagcggggaagtcatcaagaggatgcttgcagctgagacggaaaagctgaaaaagacggcctgggtcaagatatatatggaaaagacggactatgacatgatggtggaggcggacgcggatgtggtcagtgaactggccaagctgtcggataatataaaattcgtggtcatggataaggagtccagtggaaactgcatcattgagatgccggatgagatagttgatatcagtgtggatacccagatggagaacatccgggaaatactgggaaatatcaggttttaggagtgcttatgtttgagaaaatccccaaacttgtttctaaatcagaaacagtcagccatatcgggaaaattgaaaatgtggtgggtatgttgatggaggcttccggcggaaggtgcagtatcggcgatatcgtgatgatttacaacgaagagcagaactgccagatgccggccgaggtggtgggctttaaagacggaaagatacagattatgacatatgaggccacaagcggcatcacctcaggaagctttgtccgcaatacgaaacgccgcctgaaagtgccggtgggggattttctcgtgggcaggatcatcaatgccatggggagtcccatagacggcaaggaggagtttaaggcgaaccgcttctacacggtcagcagtccttataccaacccccttaaccgtccccctatcagggaacgcctggagtttggcattaaggccatagatggtcttaataccattggaaaaggacagaggattgggatatttgcaggttccggcgtgggtaagagtaccctcatgggcatgatagccaaaaatgtgaaggcggacattaatgtcattgcgctggtgggggaacgtggaagggaagtgctggagtttgtggaaaaggacctgggggaggaagggatgcgccgctccatcctggtggtggccacctcggaccagccggccatgctgaggatgaagtgtcctctggtggccaccaccatagcggaatatttcagggaccagggcaatgatgtactgcttatgatggactcccttacccgttatgccatggcccagagggaaatcggcctggcaatcggggaaccgcccattgccaggggatatacgccctccatctacgcggaattccccaggcttttagagcggagcggtaattttaataagggttccataacaggggtctacaccgtgctggtggagggggatgataccaatgaacccatagcggatacggtgcgggggatactggacgggcatatcgtgttgagccggcagcttgccaatgagaaccattttcctgccattgacatcggggccagcatatccaggcttatggtggatgtggttggggaggaacacaggaaggcggcctcgcatttccgcaacatgctgggcctgtaccagaaaaattcagaccttatctcaatcggcgcatataaaaaggggaccaacgcggccctggacgaggcggttgccaggataaacagcatgaattcatttttgcggcagggcattgaagagtcattcacttacgaccagaccctaagtctcatacagaatatcgcaggttaaaggagggactgctgttgaaacggtttaaatacagccttgataccgtgctggattataagacccaggtgcttgatgaactgaggtcggaacatgcggtcattgccaggaatgtcatgacgaagcaggaacagattgtcaggatgaaggaacgattaaacggttttcaggaggggtttgaccaaacgaaatccatgggcgcttccattgagaacttccgcctgtatgacatgtgtatcgggaggatggaagagctcatcagccaggagaaggaagagctgtcttttttaagaaaaagggaagagagcaaaaagaaagaggtgatatccgcaaaggtggacacctccaagtttgaaaagctgaaggataagaggatgcaggcatatcaaaaagccgagatgaaggaagaagagggctttgtggaggaattcatcataagggacattacgagaagccggtatcagggccgggtataggccggattaaggtaatcatggctgtcaggctgttgattataaatatcatatagaaaggagggacaggcatggaaaggatggacttgacacagatggtgcggcaggccgtgcagaccgcggattccggcgtatctccaaaccgggataaagaggatgacaggagcggcggggacttcctgcagatgttaagaggcaggcagcaggcgttagaccgccgggacagggaagagcggctgtcgaagaaggatgggtccgggggtaagaaaaaaccggcggtgaaacaggaggacggcgcagagggacaggagtccggacaggggctgttggaagccacaaaagcaggcgcaggcgatatcctgaagggtttcacattgcagttccggttggatcagggacagcttacaagggagtgggatgccgctgttttagaatcacatcacacgggttcccggatgccgctgcaggatccggttgtcctggaaggtgcggggaatgaacctgttaaggagccacggcaggcgctgccggattatacggtttcctggccggaaatccggacagatatggaacaacagattccggatatggggaaaagccccgctggccaggcggtaggacaacttcaggccttgggaaaagaagagccattcccggtacctgtggcagaaaaaagccgtaaccaggaagaacctgtcagagtcaaaacgatggacgggcttaccaggccggtaacgcaggaacatggaccccaacaatccgtttcggatgcccctgtgaaggcgcagacccaggacaggaccggcgccaatgaacagccggaaaaggaactgcccttggctcatgcagtggattcgcggccaatggtatccaatcaggattttgggaccgtgggacaggcagaggcacaaagccctgtgaggacaaccatggaggaactgcctgaggcgtttgccaaggccctggcagacaggatgccggataataacggcacgctgaccattgagtttgaaccggcttccctgggaaaggtgaccttgagggtcatatatgaggctgggcgtacatcggtgtcgctgatgtcggacaaccctaagacactggaaatcctcagccagaatgcggggcagatagctggaatcctggaggataagacaggcagggagacagtgatatacacatatcagccacagcagcagtttgctgatagaagggaaagcggcagggaagggcgcagggagccggggaatcagaaaagcgacagaagaagggagcagcgggattcatttgcgcagcagctccggctgggccttgtataaacaggaggatgaaacagatggcagatggtattacggtaagcggaaccgcggacccttatacacaacaggtttattcagcaggatccaatgaaaagaatacgctgacagttaccagctttatcaagcttctggcagcgcagctggccaatcaggacatgaccaatcccatgtctaacagtgagatgatgggccagatgacacagatggccatggtgcagtccatgggcgccatgacggattccatcaccacatcgacggcggttaccagtcagacgtatgccgcaggcctggtggggcaggagcttacggtggcagtaacagaggaagggcctaacggcctgccggtgccggtaaatgtcaaatacggaacggtggtatccgtgaatctgaccggaggcgtgcctatgattaagctggaaggcgatgatgaggaatatcctctttcctatgttcttggtattggccgcattgataatccttatgcggaggaagggaaggataaggaagaggaggataagggaggagaaagtgaagaaataacggaggaaggtaaaacagggaatcccctcctggatgagaacctgtatgtctgatttttttatgcatatcagggaggaagaatatgatgggagtaaacggagtatataatccaggccttgcccagacggccggaaccggcaaagccatgtccggacaggacgggaatggccggggtgccagttttggcgagatcttaaaggcccgtatggatgacagcctgaatttttccaaacatgcctccagacgtttagaggagcggggcatcgcggttgacagccagcttttgggcagactggagcatgcagtggaggaggcgcgcaggaaaggcgccagggatgtggcggtcataggcagccagggcgtgttcattgtcaatgtgccgaacaacgtggtggtcaccaccatgacgcaggaagatatgaaagacagggtttttacaaatattgatagtgctgtcctgatgtaggcaggactgacagagtgcctggccggatgccagaagcgcaccggcaggggcagcagaaaggactgaatcatgttaagagcaatggactcagcggtcgcaggtctgcgggcgcatcagagtaaattagacgttataggaaataacatagcaaatgtcaacacctttggattcaaggcacagacctttacttttaaggaggctatgtaccaaagcgccgtcaattccaccggaggggtcctgggaacggctgcaggaaccaacggcgcccaatacggttacggaacattgatgggcgccattatcacggatatgacggccagcacgccgtcccaggtaggtgggctgaacgcatgtctcaatgcccagggctttttcatcaccgcggctgtaccggacaagagcacatccctgacagggacagacacggccgaaatcacagccaatattaagggagccggttatgagtatacccgggtggggcagttccagctggacagccgtggacatctcacggacgggaagaactttgtctatggtttccgggaaaaagatgatgcaagcgatgtggatcccgataacctgatgtccctgcgggtccccacagccgcaaaactggaaatcgcaacggacggcacaacctcatgggcattggaatttgacgatgacgcggaatcactcctgacctccagcatacagattaatagcctgggtgaggttacggtgacgattccggtagacgtgaccaaagctgatggtaccacggcaactgaggaccgccaggtaaccatcggtaaggttggagtggctaccttccagaaccaggaaggacttatgaaggccggaggcagttactatgtggcttccacgggcgacaactcaggcgcctgttcagccactgtcccgggaggggccacctcctcccttatgagcggttatctggaggcgtccaatgtagacctggcaaaagagttctcagagatgattacaacccagaggggattccaggccaattcaaaaatcataacggtcagtgatgagatattatcagaattggttaatatgaagcggtaataatatgaagcgttaacatcgtgaagtgttaacggacaggttttccctggttcctttcgggaaccggggaaggactgggaaagagggggcatatgataaaagtcatccgcctgaacggagaaatactctatctcaatttgttccagattgaatacatggagtcgattccggagacaaagataaaaatgatgaatggtaattattacctggtaaaagatacggttgattcaatcatgaagcagatagcggtattcctgaacaactgtatgaactttgatgacaaatcaaagtaaagctgtgggcacaggaggcatcgtaacatggacataacaacattgattggaatcgcagttggcgctttcctaatcgttaatggaatcggagccgacaaattggggaattttgtggacaggtccagtatcctgattgtcgtgggagggactcttgcggctacggttgcaagctatccgctgtccatcctgatggatatccccaaacatatcatggttcttttccgtggaaaacaatacaacattccgaaacttgttgagcagctggtggatctggccatgatagcgaggcagaacggccttctggccctggaagaaaaggcggatgagataaaagacccttttttcaaacagagcgtactcatgattgtggatgccaatgacccggataaagtgcgctttgtcctggaacgggagctggaaaacatgatgacacgtcatgacgaggtagcgggattgtatgaaaaggcatcggcctatgcgccggccttcggtatgataggaaccctggtaggactgattaatatgctcaagggcctgaacctggatggcgaaggcggggccggcaacctgggacaggatatgtcggtggcactgattaccactttctacggaagtgtcctgtccaatctggtattccatcccatagcaaagaaactgcggatacgccaggatgaggaagaactatactgttccaccatcatagaaggaatcatcgcaatccagtcaggggagaaccccaagtatctgagggagcatctcctggcctctatcaagcagtcacagcagaggaaacttctgtcaaaagcagaagccggcggcggtaagggcggaggaagcacggatgaagaataaaaaaaacaggcctacggatggcggcggaaactggatggatacatatggggacatggtgacccttctcctgaccttctttatcatgctttttgccatgtcaagcctgaaccagcagaagtgggaactgttcgtgcgcagcatctatccccattctaatgaggaggtacaggagcaggtggcgattaatacgcctttggatgataccagcagcaagatagaggggacgccggatattccggagaccatggctgaaatcgatattgacaagctctatctgaccctggcagagcggatgaatgatatcggcatagatggcgtgaccatatccagaggcgaagattacaccttcattgtgtttgaagacaaaaccttttttgacggtgacagttcaatcctgacagaccagggcaagactaccctggatgtgttttgtgatgtcataagccctgcccaggacggtgtgtcgcagattaatatcatggcgcatacggcccaggggaacccggaccggccaaacaatcccaggacggaccgtatgctgtctgccatgcgtgccgcggaggtctgtatattcatacaggaaaaagggataatcgagcctgaaaagctggtgaatataagctatgggcagttccgcccggttgcggataacagcacacgggagggaaggactaaaaaccgccgtgtggagatactgatgattgatgagggggcggaccttcattccatgaaccggtattatgatgagtacaacagcggcgtaaatgcggacaggacagtggtcacgggccaggaggccaatggaaccggccatgggtttgcacctgcatcccccagcgccgacggcgtatccactaccatgtcccccctgacggacagcacggagaacgcgtctgctgaacctggtctttcttccgatggtacggcagaagaggccggaggaacagtggctgaataaatttagtaaaggtggctttagcaatggcagatgtattatcccagagtcagatagacgcgcttcttaagtccatacagggcagcgggcctgaagaagaggtgcaggcggttgaacagaagacagaagcagaagaaacaaaatacagcaaatatgatttttacagtccaaggaagttcactaaggacaagatgaaaatactcaacagtgtatttgaaaactatgccaggatactgacttcccaggtgaacggcatattcagggtactgacagatattacagtgctggaggtccaggagcgcaggtactatgagtttgtaaactcgcttcatgagaatgacagtattaccatggctaatgcggaaatccaggataagataaagaacaatgtcccgcttatgcttcacgtcaccccgggacttgtaatcacgcttattaaccacatgctgggcggcggtgatgagattgtcaaggtagagccgaaataccgctattcggatgtggaggtggccttgtaccggcgggtggtggaatactttgtcctggcattaaaggatgggttttccaattacataaatgtcagctttaaggttcagagggtggaggaaaacccaagcatggtccaggaggtggggctggatgaaaccgtggccatcgtgcacctgaatgtggatgtggcgggactggcggtggaaaagataaagctctgtataccgggaaccctgctagagttcattttccatctgatagacagccgcaagcatatagcccgtggctttgcctatgaggataacaaggaggtaatcctggatcacatccgtttctcccagcttcccataacggggcagctgggaaccgtggagctgggccttagggatttggcgcagcttcaggtaggcgatgtgatcagccttaataagccaaaggacagccatctgaagatattcgtggggagacagccgtggtttaccggaaagatgggggtttacaagaaaaacgtagcaatccgtatagaagacaggatctatgccggaccggagaaagaacgggatatggaaatcctggatgattaaaaatacaaattaaagtgagggaaagcaccatggaaaagattatgttggtagacgacgctgcatttatgaggatgatgattaaaaatgcgttgacacagaaagggtacagtaattttgtggaagcccaggacggggcggaagccgtgaagaagtatgatgaggaaaaaccggacctggtcatcatggatattacaatgcccaatatggacgggcttcaggcccttaagaaaatcagggaaacagacacttccgccaagattgtcatgtgtacggccatgggccaggagagcatggttgtggatgccattaaatcaggcgctaaggatttcattgtaaagccctttaatgcggaacggattgtccagaccgtcaattcaatcttaggcaaataaggaggaagggtaatggcatttttaagctcattcgatatctgcgcctccggtatgagtgcgcagcgcgtaaggatggatatcgctgccgaaaacatagccaatatcgacacaaccaggacagaggcaggaggaccataccggaggaaagacgtgatgtttgaaagctacggcacaggctcctttcgggaagccctgctaagcgccgcccagggaaaaggctttgccagcaggaatgcgggagtaagggtatcgggcattgttgaggatgaccgggagatgaagcgggtgtacaatcccagccacccggatgcggatgcggatggatacgtcagtctgcccaatgtggatttattgaaagagacagttgacagtatgtcagccaccaggtcatacgaagcaaatgtaacagccctgaacgcaatgaagctgatggcacagaaagcactggagattggaaagtaagggcgaaggtggagacatgatgatacaagaaggagataaagatgggcgttagcgactttaatgatatggaactggacgccataggcgaaataatgaatatcagccttggtgcgtccgcaacagcggtttccaccatgctgggcacaaaggtgaacattaccacaccggtagtgcgggtgctgacaagcgatgaatttgagttcaagagcctggagccggctgtaggtgtggagatagcttatacggagggccttgagggcagtaatatcatgatgttccgccgcaacgatgtgcggattatcgtgggaatgctcatgggggctgatataccagatgaagaatttgaaatgaacgaaatcaatgtgagcgcaatctgcgaggtcatgaaccagatgatggggtcttcggccacagcgctctcggaatttcttgggaatcccgtaaacatatctacgcctgtttcctttccgattgaaagcgagaatagttttaaagaaaaatatttcacgccggatgtgaagatggtagtggttcgtttttccttggagatagaagggaaactggaaagcgaattcttgaatatcatgtcatccaagctggcaaaacacctattggaaccctttgagatcagtttccagcaagcggaacagtatcagatggaggaggatgccagaaagcaggcggaggaggtccgtgaggaaccggcgcaggaggagcctgtaaatgtggcggagacagccggggaaggatcggccgtaccggagccatcccctgacaacgctgcccagggcgggatgcaggcggccccaaaacccatccaggaacagccgcagcatgcgccttcggctgccccggaaaccgtccaggaacagccgcagtatgcgccgcaggctccccagcctcaatacgcgcctcccatgggacagccagtgctatatcaatccgcaccagatccggtcatgctccagctgctgaaccagatgcagcagtcccaggcccagatgatggagttcgtgaaggacatgaagacgaaggaaaagcagcagccgccaagggataatatcctgatccatccgttaaactccccgcagatggagaacgggttggaagagggggtggaggagcgggccaaccaggaaatgctcatgaaggtcccgctggaactttccgtggaagtgggaaggaccaagaagctggtcaaggatatattggaactgacccagggatcccttgtggtattggataagatggctggtgagcaggccgatctgttcgtgaatggccagtgtgttgcaaaaggtgacattgtggtggtggaagacaactttggcatccgtataacggaaatcgtggccagggacctgaacccggagattttatgatggataatagctttttatcattggcaggcgcagtacttaccgtgggatgtatattgctcctggcatactggtgcagccggcttatgggaaagacatacatgaaagccacatccggccggaaccttaagatccttgagcaggtccggattggagctgataagcagatccttcttgtaaggttacggtcccacatgtaccttatcggcgtcagtcaggcgggaatccagatgttggaaaagctggaagaggaatacggggaaccggaagaaagggaggagacaaatgaatgatctgcttgccggcctgaacgggggcaatgtcccggcgcttgatttgatattcatgattaccctggtggccctgctgccctccattgcggtcatgatgacttcctttaccaggaccatcatcatactgtcatttaccaggaatgccatggggatacagcagacacctcccaatacggtcctggtaggtatttcgctgttcctgaccctctatatcatgagtccggtcatcggaagggtcaatgccgaggcttaccagccttatacccggggagagataacccaggtggaggcagtgcagaggatggggggtcccgtcaaggagttcatgctcaggaacacggaaaaggagacgctggatcattttgtggaaatgtccggaacccagacagaggaaaatgttgaggactatccatttaccgtggtgacgcctgcttttatgacaagcgagctgaagcgggggtttgtggcgggattccttatctatcttccctttctgctgattgacatcgttgtggcaaccaccctgatgtccatgggaatggtgatgcttccgcccaccatggtttcccttccctttaagcttttgctgtttgtgactgttaatggctgggaactgctgttttccagtattgtcaggagtttccgttaggaaatcctgcgtcaggaggtaattatgactaatctacaggtacttgacatcatgtaccaggcattccagctggccctgaggctttccatgccgttcctgctggtgagcatggctgtgggcgtccttatcgctatattccaggcagccacccagattaatgagcagaccatgacttttgtccccaaactcctggccatcctggccatgatgggaatcctgggaagctccatcctggccatgcttcaggactttacacgtcaggtgtgtgccatgatagcaggaggttaacagggaatgctcatcttattttccctgattgtcatgcgcatgagcggggccattgcccttaatcccatgttcgggagggtcaatttcccttccagggcaaaggcaggctttgtacttctgttgtccctgctgctctataccaccggcggggccggcatgtaccgcggaccagccaccatggtggagtacgccgtcatgctgctgatggagctgttcattggttacacacttggttttgcaatggaactgtcggtcctggtggtacgcttcgcatcttctgcaatggactatgtgatgggtcttaatatggcccagatttatgatccgcagtacaacacccagatgaccattacatcgggaatgtattatgccttcctgatgcttctgttttttgccatggacggccatctcaggcttcttgggattatctatggctcggcccgcctcgttcccttcggggcggtgcggataagcccgggactggcactggcggtcctggatatgttccagcagggcattgtcatgggccttcagtttgcgcttcctgtcatcggccttgaactggttgcggagacagcggtgggaatcctgatgcggatcataccgcagattaatgtgtttgtggttaatttccaggtcaagatcatagtgggcatgctgatgctcctgttcctgttttctcctatgtcggacaagctgtatgacatcctggattacatgttccagtggctggatcgcatggtaagcctgatggcctgagactggcagggggaacgaggcagcaaaaaagggggtgaggggcagtggctggaagcaacggacaggaaaagactgagaaaccgaccggtaaacggcgccgggacgccaggaaggaaggcaatgtattccagagcaaggacataaccacggtcatcctcctgctgggggtattctggatgatacggctcatgatgccttacatctataagaatgtaaggtcatatatggaatggatcctggagggggtgggcaggaatccgcaggaacttatgtcctcccagctgttttccgtaaccgtgcttacgttccttaaatgcgccctgcccctgcttctgaccgcactgctattgggtatcctggcccatgggacacagaccaggttcaatgtgtcttttcaggtcgtaaaacctaaatttggaaagcttaacccttttaccgggataaaaaaactctttgccctgaaaaatgtcatagagcttgtgaaaaacctgtttaagataagtctgctgttaatcctgctctataacctgataaagggagacctcgtgcctgtggccaggatgattgacatgcagcccctggtttcggctgcttatatgttaaacatggcttttgacctggtggtcaaggtcagcatggcttttggtgtggtggctttctttgatttcctttaccagcggtgggaatatgagcgggaccttaagatgaccaagcaggaggtaaaggatgagttcaaacagacagagggtaatccggagattaagggacgtatacggaggatccagcgtcagatggccctcagcaggatgatgcagaaggttccccaggcggatgtgattgtcaggaaccccacccattatgcggttgcccttaaatacgaccccagccatcatggcgcgccggtggtcctggccaaggggcaggatgaactggccctcaggattgtaaaggtgggggaggaaaacggggtttatatcacggagaacaaacctcttgcaagggccttatatgcctcctgcgagctgggacgtgagatacctgccgagttttacggtgcggtggcggaaatcctcctgtatctctaccggaccggacgcagggaagatatgttcagataaacgaatcggatggagttacggatgaagaagatactgagttattcggtcgtactttttgtactgattatcatactgctgttaatcataccgctgccggctggtctggtggatgtggcaatcatattaaatatgtccctttccatgatgatcctggtaacgaccatgacaatacgggaacccctggagttttccattttcccgtccctgctgctggtgaccaccctgttcaggctgggaatcaatgtttccacaaccaggaacatactgaccaatatgggttcatcgggccaggtcatcagggccttcggcgactttgtgctccgtgggaacgtggtggtgggttttatcatcttcctcatcattgtactgatgcagttcattgtaatcaccaagggcgccgagcgtgtggctgaggttgccgcaaggtttaacctggacgccatgccgggtaagcagatggccattgacgctgatttaagttccggcctcatcaatgagcagcaggccaaggagcgcaggcagaaaatccagagggaagcggatttctacggggcaatggacggcgccaccaagattgtgaagggcgatgccgtcatgtccctgattacaacggccatcaatctgatagggggaagcatcatcggtatcatccagtccggggaatccatcggcgatgtactgaacacctattccatcgccacggtgggagatggtctggtgtcccagataccggctctgctcatatccacggccacgggtatgattgtgaccagggccgtgtccgagggaagccttaatgaggacatctccaaacagttcatggcccagccctattccattatgctcagcggcgtggccatggctgtcatgaccttgataccaggcatgccggtcatccagctggggatggttgcggtggggcttctggccagcggttattacctgtccaggaagatccaggcagaaccggcccttctgggcgtgaccgcgtatcaggaggcacagggggaacagacggccctggaggaggcggctgcatccatgccggtgacggaggatgagtattacaaggatgtgaataacgtatataaccttctgaccgtggagccggtggagatggaattcggatacagtctcattcccctggctgacgagtccgtgggaggcaggctgatcagccggattgtcatattccgcaggcagtatgcccaggacatgggatttgtcatcccatccatccgtttgagggacagttccgctttaagcacaaaccagtactgtatcaggattaaaggcgaggaggtggccaggggggaaatccttatggattattatctggccctggaaccggagcatcctgaaaaggaagtggacggcatagagacagtggagcctgcctatggaatccccagccggtggatccggccggaggacagggaacgggccgaggcatacggatatacggtcattgacccgctgtcagtcatggtcacccatctgtcggaggtcatacgccagcatgcctttgaactgattaccaggcaggaagtgatacatctggcggagaatgtgaagaagaatgcccctgagctggtggaggaggcatttccaggacttatcccatacagcctgttccagcgcgtattgaccagcctgttaaaagagggtgttcccgtaaaggacctggaaaccatccttgaaacaatgatagatgtggtgtctgagacaggcctgcctgtcaaagatattgataccatcgtggaacacataaggacagcccttaagcgcaccattacccggatgtactgtgaggatggaagcatgaaggtaatcacccttgattcggaactggaacgcaccatggtcagttccatagcaaaaggggagggagggtattatctggccctgaacccggacctgcttcaggggcttatacggcagatggcggaacagcttaggaagtttaacggctttacccagaacccggtcatattgacctcccagatcatgcgggtgcatttctaccgcctgattgagcagttttacccaaaggtgcgggtgctttcatttaatgaggtggcaaataatgtccagatacagtcaatcggcagcctgaaactggaaggaccggggctgcaggatggctgacagtgaaggatgatttgatatgcggcagttggatgaattgaaggaaaagacaaatgaagagctgctggccatgtatgtcagggacaggcagctggaagtgaaacaggagcttacgctccgatatctctatatagccaaggcggttgcaatccagatgcataacctgtatgcggatttcatgcagatggaggatatcatcaatgaaagcgccattgcaatcatgaagggaatcgaccggtatgacccggaaagggacaataaatttgagacattcatttccagacgcatccgggggatgattatagatatcatccgtaaaaatgactggatgccaaggaattaccataaacagcacagatccattgagaacgccaggattgagcttgcggaccagtttgggcgccctcccacggatgatgagattgcaggccatctgaagatggacgtcaggaaatgccagaggcttcagcggatgagcaccatggtaaatgtgctgtcgctggacatggtaacaaacagggaggaggatgggcagtcggtccagatacccagcagtgacatggacctgcagcctgaatcagcttatatgagagaggaagcagtcagtatcctgacaacggcggtcgggaaactgaaagacaaggagcggatggtgatttccctctactatgtggaggatctgaacatgacccagatagcccaggtgctgggggtcagtgaaccgcgtatatcacagatccacggcagcgccatccggaaactcaagacttacatgaatacctatatttacgaataggaacaggaggaaatgccatatgtaccagggattttacaatctcacatcaggaatgctgacccagggccgtaatctgaatgtcatcagtaacaacatggtaaatgtccagacatcgggctataagcgggataccatggtcaccagcacattccaggaagaaatgctctaccggaccggacggcataacaaggaaaaccccacgcctcttgccgtcacgtccaagataaagaccgcgtccaggacctatgtggaccacgaccagggaagtcttgaacagacagacgggatttatgattttgccattgggggcagcggttttttctgcatccagaccccggatggcgagcgctataccaggaatggttcctttgccgtggatgaggagggatatctcaccctgccggaggcggggcgggtgctctcggaagatggccagcccatacggattgatgatgaggacttcagcgtggatgccaggggccgtataacggtttatgaaaggcaggaggaggattcgcaggaggagcctgaactccggcagttaggcactataaggattgtggattttggggactatgaccagatgcacaaggaggacaacggactgttttccacgtcccaggcgcctgtccaggcacaggaggaaccgccccagattttctggaagaacgtagagaagtccaatgtggacatggtggacgagatgaccgccatgatgacttcccagagggctcttcaaagcgcggcgcagatgctcaggatgtatgaccagatcatgagcaaatccgtgacagatgtaggcagattgtaaggaggggacatatgaaccagtcattttacgtgggagcgctgggagcagggaactgtacggaaaagttcagcgtgatttccaataacctggccaatgtgaacagcaatggctttaaacccaagacatcggtattttcacagctggtcagctacaacctcaatgatgctgaggatgcggtgacagagctgcaggccggggccggcatgaaggtgcagaggacctataccagctttgacacggcagggctgacacagacgggaagcaccatggatcatgccatactggaacccaatgcattctttatggtgcaggatccggccacaggggctgtcagttatacgcgggacggacattttcacagggcggagcgggaagacggcttttatctcatgacggacgcaggcaagctggtactggaccagaaccgggaaccacttaaggcggatgtcacggatgtggataaaatacaggcggaaatgggggaagaggaggaagagattgaggaagaggaggaagacgagaacgaggaagacaaacccagggtcagcctttatacctttgccaatccaagccgtctggtcagcgcgggtaataacgaatatgtccccgtggacccgggggcgcagccaatcctcatagagagaccatccatgacaaccggagccttagaggtgtcaggtacggatatggcgaaggagctggtcaggatgattgagtgccagcgcgcatttacctatgccctgcgcatggtgaccacctccgatgagatagagggtaccatcaataccctgcggggttaatgacagccggggaagatgaacggaagaaagcgaggcagacatgaaaatcaggaattatggggatttgaatcttcaggaacttgacataatgagggaaatcagcagcattggcacaagccatgcagccacagccctttccaagttcctccagaaggagatacgtattacccttccccaggtcagtatcctgggatatgaggatgcggtaaaccgcatcggtaacattgaagaagtggtggccgccacactggtgaagatggacggggatgtggacggactaatgctgtttttatttaatatggattttgccaatacggtcctggaaaagcttctgaaccaaaactatacttcctttgaggaaatggatgcgttggcctattcagcgctggaggaagtggggaatatcattatctgttcctatatcaacgccttttcacaactggtggacatgagcatccatctgtccgttcccagctccacggtgaacatgctgggcgggatactgacggtacccattgccgaatatggctatgagacagataagctgatgtatttcaatgctgattttgtaatggaagggaaacggctttcagactggctgctgatgcttccggacatccgttcgctgaatcatattttagggaagctgggtgtttagagatggcggaaaaggaaatcaaggttggaattggggatatgaagtttaccagggaggagggcaggatcatcacatatgctctgggatcctgcatcggtatatcattctatgatccgtttttgcggctgggcgccctgctccatatcatgctgcccgcccagaacggactctccgaccccaatatttataaatatgcggattccggtatccgcgagaccatacgtaaactcatggcctttggcatggtaaaagccaggacaacggttaagattgcagggggcgcaaagatgtttgaaatccgggggaatgcggattttgggaatatcgggcagagaaacgccgccatggtaaagaaaatactggcaaatgaaaatatgaggattgtggctgaagatacaggcggtacatacgcgaggaccatgctgctgcagctggagagcggggatgtcataatccggacgtttggaagacctgaaaagcatttatagtagaaaggagttttagtctatgcagaaagagaaggaaggcatcctgctggaatcagggacaaatgaaattgaaatcatgaaattctctgtcttgggcgaattttatggtattaacgtggcaaaggtaagggaaatcatcatgagtgagaaggtgaagcccatgccccatgcacacccggcagtggaaggaatctttaaacccagggaatcactgattaccgtgattaaccttgcatactatctgtccgggacacggccggaaaacggcggaagggatttatttattgttaccaatttcaataagatgacagttgccttcagggtacaggggattgagggtatcagccgcatctcctggagggacatacagaagccggacaagaccattgccaatggggatgaaagtgttgcgacaggcattgcccaatgtgaagggcagctggtaaccatattggattttgagaaaatcgttgcggagattgcaccggagacaagcatccaggtttcggaggttgaggccatgggcgacaggcccctgtgcgaatcccctatcatgattgcggaggattctatcctgctgcggcggatgatagatgactccctggagcgggcgggttttacaaacatcatgaattttaacaatgggcaggaggcatgggattaccttgtatcaatcaaggatgatccggatctgtatcagaaggtgaatctggtcataacagacatcgagatgccggagatggacgggcatcgtctgacaaagctgattaaggacgacccaaggcttaaaaagctgccagtggtcatattctcatccctcatcgatgagcagatgcgcaggaagggcagggagctgggagcggatgaacagctggccaaaccggaaatcggccatcttatatccattctggacgagctgctgacaaagtacggccaggacatggaaaaaatgcagggacagaagcatgcttaggaggatgaggacatgaggtatgagatgacaaaggacctggaaaccggcaatgccttgattgacagtgaacaccgtcagctttttaaggcggtgaatgacctgttggacgcctgttcccagggaaaaggacgcagctatgtggaatccaccctggatttccttgtatcctacgtggctaagcattttggggatgaggaaaagcttcagtcacagtcttcatatcctggatacgctgcccacaggcagtttcacgaagcgtataaaagggagttggacagggctgcccaggatataaaaacccagggcgcctccatcgccgctttaaacagcctgaaccagatggttggaaagctgttgatgcatatcaggacggatgacaaaaaggttgcccagcatgtaaagcagtcctgactggcggggcggaggggaaccgcgtatattgatggaaagaagatgtaaaacagtatggatataaggaaaatcgtagatttaaatgagttccagaggatacaggacctgttttccgatgcaacagggctggccgccattgccgtggattcccggggagagtatatttccaggggaagtaattttacggatttctgcatgaaatatacaaggggaaatgcggaaggccttaaacgctgtgaaaaatgtgacagggagggaaagggttcctactactgtcacgcaggccttatggattttgccgcggacctggtcatcaatggggagaaggtaggcactgtaatcggcgggcaggtgctccccaagaagccggatcccggaacattcaggaggattgccggagaacttgggattgatgaggaggaatacttaaaagcccttaataaggtacctgtccggtctgagaaaatgatacgttcttcagcggaactgttttccacggtcatgaaccagtggattaaccttagctattatcagaagataaatcagtcaaagatgcaggtatttaaccacgaatcccagaaggtccaggacgcgatggggcagattaagtctaagacaagacagctggagcagactgcaaccatggagaaaatgctgtcactgaacgcatccattgaggcaggccgggcaggcagggccggagtgggattcagcgtggtggcggaggaaatcggcaggatggccaatgaatcatccgctgtgtatggtgcaatccatgaactggtggaccgtgtggaggattcgattgaaaagatgggtaaaattgagtttgaatagatgcatcccggtcctggtttcagcggccctggtccttgccgtgccctggggcgttcatggagcccaggaggggacctgggaccggtcggaggatggaaaatactggatgtacttctattcccctggcaatccggcagaggatgaatggattgaggaccaggggaaggaatactacgtggattccaaaggccgtatgaagacgggatgggtaacggacaaaagagacaaaaacaagtattacatgggggaagacggggccaaatgctttaacatgttcacgccggacggtcactatgtgggaccggacggacttatcctggaatcctttgacacctacaggaaggctgttaaaaagcagcttgaaaggctgatgaaggacaaggcctataaagaaagggacggcgccccgcgccccggtttcatgctgtgggacataaacggggacggataccgggatgtggtggcggtggaccgtgcgcagatgcctgggcgggtggtactgactgctgtctgggacccgttggaggaagaactggtgcctgcctcgcaggcagatccggatgatccggatgagtctttcctttcctataaccaggacagccagtccgtgtggcttaccattgcaaaggatagcggtgaacgggacttcttccagatgaaggacaatggattccaatttgaggacgtatggcatttcgaactggatcaagatgattggggagatgccgtatattatgtaaatggggttaagtatgacgcgcaggagtggggacaggcccttacccaggccagcctggaagcaggcgccgctgtgacggaaggattccttccactggatgcagggacggtgaaactggcagtggattgcagccctgaggaagagatgcccctgtggcagcaataagtccattaccatacataaaataagattaaattcggaggtaacgctttggctactatcataactgtttccaatcagaagggcggcgtgggaaagacaaccacttccgctgcactggctgccgggattgcggcaagaggactgagggtgttgggcgtggatctggacccacagggaaacctgggtttctgcctgggcgtggagtcggccaatgggcctacggtgctggatgcgttaaaaggcgcgcttccggttcaggaagccatctgccggacagagtactgcgatatactgaccgcggacatcaccctcagcaacggggtggagcgtacatcctccggtcctggggaatacatactgaaggacacgctggaaccggtgatggatcaatatgattacatcatcatcgatacaccgccggctcttaaccttctgaccgtgaacgcttacacggtttccgattacctgatcataccgctggcatcggacatcctgagtctggtggggctggcgcagctcaaggaaaccatcgagtctgtcagggaaagctttaatcctggccttaaggtcatggggatattgctgacccgctttaataagcgcacccttctctccagggatgtgatggagatggctgagcagctggcgtcccagattaataccgtggtgttcaggaccaaaatccgcaccggtgtggccattgcggaagccccggcccatggtgagagcatattcgactataacccgcgctcgtcagccgtaaaggattaccaggacttaatccaggaaatcgcagagaccatctatctaaaggaggtgatggagagtgccaaggaagaccaataagacatcccatgtgctgaacctgattaccaatggaagcgctccggaacaggaggataccgcggatggaaaacaggaagaggcagaacagggaaaacaggacgtgaagacggaagggggaacgcttaaggaacccgtgccaagaatcacggcctccggcgataagacggtcattgtggtggatgataccagccagaatgacaatatttccagcaagatcctggaccgtctcacggaccagctggaggaggagatacagggaaagctggataattaccatatggttaatgtgatggagcagatccttaagcggctgaacctgagccattacatgaagcagtatgacgtatgtatgtgcagccgctgccagtcggatgtgacggcgctgatcctgaccaggctccctgcaaagtatgttgtggtggacgagagctccacggctcccatcataggatattatgaaagtaaatacaaggtaaggatcctcacggaaatcattaaggcgtgtatggatgtaaaagaaaatccgaggcacgaccgttccggcccctatgacaaataaagaataaaaagtgcacaggttgataaacttgagcactttttattatttttttaatgaaaccgccgatatataaatcatagacaggaagcttataaagcagtggatgtgagaggagaatacagatggcaagcgtatcaggggcaacgagcagccttgggaataccagtttaagagggtatggcggttttggttccggaattgaccgggattccattattgagcagatgacggccggaacccagtctaagataacaaaacaaaagaataagatgacaagccttggctggaagcaggaggcatttcaggcggtcagcgataagatactggctttgcaggataattatttttcctttgcttcgggcagcaaccttaaatatcccagcatgtttgcgaagaatcagataacatcggtgggggattcggatatcacgaagtttgtgtcggccacagggtcttccaatatgttggattatctgtccatactgggggtgaaccagctggccagttcttccacccttcagtctgcttccaaaggcacttcatcaatcaatacaagcataaccggggacagccttaccaaccctgtgtataaaagttccctgctgcagggaagacagctgaggtttggcacatatagtggggaccagtaccagtcggcaggtatatttacctttccgccctcttataaagataaggatgcggacggcagggatatcaccgtgcccatcgactataccatagatctgaatgccacggtggaagtggatggggtatccatgacgggaggggaaaaactggccatgcagttaaataaggcattgtcccagtcaggcatacagtcaggagaggatcctatttcagatgtgatggaatttgtttataccccaggcggcacaatgcagttacaggccaaagcagggacaagcaccaacctgatcatcaattccagttcaagcgccctcaccgccctgggatttaatccccagaatgcggacgggagcgacaagacggtttcagatggaatcaatctggatgaactgaatgcaaaccagaacctgtttaacgatacttatgtgaacaggcagaccatgacccagtatcttacaggaaaaaaacttacaatcagctttggcggccagacaaaggaagtggagctggttaaaagcggcgacaccttctcaaccctggatgatttaaaatctgtcatacagggcaggctgaaccaggcctttggtacaaataatattgaagtggccggaggtacgcgttacgatgcggacgggaacccggtcattgacccgctgtccttcaagttaggaagcaacgcatcatccaaccagacactgacggttacctccgacaacgccgaaatcaggaatgtcctgggtatacagaagggcgccagcaataagctgaacctggaagggagtatcagggataatatggataagctgataccgggggacggtcctgacgcagaggcgaagcgggcgcagttccttagctccctggagtcagatggtctggtaatcaatggtgtaaaaatcgccggcgtcacggctgacaccagcatccaggctatgattgataagataaacgacaacaaggatgtgggggtcaaggcttcctacctcagcagcaccaaccagttcgtactgatttcagctgagacgggcagcggcagggagattcagctggatggcgcctctgcggatttattcggagccataaaggatgcggacggcaactatatagatggaaattttgatatgggaaagaatgcccagattctggtaagctacggcaacggcatcaatacaatgattgagagctcctccaatacctttgaccttgagggactgagggttacggtatcccaggagtttggggatctgaccgaaacaggcggtgtctggagttccgacaggtccaaggcggttaccttcagcgccaaagccgacgtggacggcgtgaccgagatcgtgaagaagttcatcgaagaatacaatgagatgataaaggaaatcaacacccaggtcactaccaggccggataaatcctacgggccgctgactgaagagcagcaggaggaaatgtcggataaatccattgagaactgggagaagaaggcaaaacaggggctgctctacaatgatgccaccatgcgtgcgctgaacttggatatgcagggaatactgacaagcctgatggcaaacggcgccaactacaaggatctggaggaaatgggtatttccatttccgatgattacctggacgggggcaccatagcctttgatgaggctaagttcaaggccgccatgaccagcgaccctgagaaggtgtccaatatctttacaggcggcggggatgtgaagaaggggctggccagtatcattgaggataccctgaccccctatgccaccaaatatgccaacaggaacggcaattcctatggacgcctgattgaggaggctggttctgagaagataccgctctcagtaatgaataaccagatttatagacagttaaaacagatgcagcaggacctggatacgctgaatgcaaggcttgccaatgaacaggaccgttacatcagccagtttaccaccatggagacattgattaaccagatgaatagccaggccagctatctggcccagttccaggcgtgatggaaggcatgtcgtatctgccagggaaggaaatggaatgaacggttatcaaaaatataaagagaacagcatatactccatgagcggtccggaattgctgctgttgctgtacgaggaggcaatccgccgcctgtcaaaggcggagtatgcgctggaggataaggaatacgggatatttgaagattcccttttgcgcacgtcacgtattgtccggtatctgattgatatattggacatgcagcagccaatcagccgggatttaagacgcatatacaactatctgatttatgatatcagcaggattaaggccgggcgggagcgggaaaaggcggagataggcaggatccgccatatcctttccgaattaagggatgcctttgaccaggccagcttaaagaccaaggacacgcacatggtccagagcaggggaatcctgggttaggagataatatggcacttgatgtggaacagatcatgttcctgctgcagagacgtttaaatgggatgcaggaaatgaaaaggctcacaggagaacttctggagtcagcttcaagaaatgaccaggtatccattggacttcttcttcagatgcgggctgatgagatggccaggcttgaagcggccggggaacgaatctggctgatggccgaacaggggccggaggaggcaggacaggtccgcaggctgatgtcccaggaattccttaaggccggccgtccggagggatttgaggagggaaggatttttgagatacgcagtaagaccgcttcactgctgaaccaggtcagggaggcggaccggcgcctgaaccaaagcattggcggcgggcggtcctactatgcatctaaataaataagaaaggaggaaccgccatgattgttaacggcatatccggcagtaattaccagtatcagggcatgctcaatctgatccggctctcaggcacaggacgttcttcaggttatcaggccgtaattcccgtgaagcgggtggattcggccacatcttcgtccaaggctgcttatggggatatacaggattttttaaagagctatcagtcaaagctgacaggactggagacaacggccgccaggcttacccagggcagcagcaaaaatgtatggaatgattaccaggcagccacaacggacagctccgtggccgtggcttctgggacctacaggctgaaaggagatacggatatcaccctgaatgtccagtcccttgcccagacgcagcagaatgccagcgcggcccatcatgcccaggagcaggtggatgcaggggcggatatggactttgagattacggggcctgatggcaatacggcgtctgtgtccataagcagtgtcaatgataatgggacagccaagacctatcatcagatgtatcaggaagcggcaggggcaatcaatgcccagtccggcgcaggtgtccgggcatccgtatccaatgtggagggaagggtatccctggttctttcatccggcagggaaggggaagcaggcggatttacggtcagtggaaccaccggggcagcatccgggattgagaatgctgccatccgggcacaggacgctgtttattcggtgactgaaaacggaaccacccggaccctgcgctctgattccaacaaagtcagcctggattacggcaggattgaggcggagttaaaaggaaccggacaggccagggtttacaccgggattgatgaggatgccgtggtttcagccgtggaagacctggtggcaggctacaatgatgtatccggttttctgaaagaaaacgcgggcaggggaaccggggcagcttcacacctggcatcctttggacgggggatggcggatgccaagaccctgaaggctgtgggaatcacctacaataaggacgggaaactggaattagacaaagatgccttaaagaacgccctggagacggatttggaaggtacgaagtcccttcttggcgggcagttcggcataggggaaaaggcggccagacgggcggagtcagccctgtcagccccggttcagaggattgtggaccgcgaccttgccgctaccgccggtaacagggggcaggatgtatcttctgccaattacaggtatctatccaattttgccagaagcgggccatacaacataaccaatttctatacggtgggtctgctgctcaacaccttggcataaagaaatgtgtttggcaaagctgtacatactctatgtgcagctttctttgaatcaggtcactgcgatgggagggatatatggatcggttaatatttgagggacgttttcttgtgaatctggtaggcggtatcgtgcgtcaggatgaccttaaggccatacacagcaggattgactgggagcatatgtaccggacggcagattaccacaagattgccaatatagtttacttggggattcttggaaatggagagaaggtaccggaacgttggatggaacggttttttgggcggtatcaggaggcgcttttttacagtgacacatcggaggacgctgaaagggagatactgacgcttctggatatgatgggaatcccatgtgtcattttgaccaccagcaggatacgcctcctgtaccagatacaggagatgtccgccaataacccgctcaggcttaaacttgacggggaggactattcgctggcaaaagggtatctggtggatttgggttatgaaacagagcggatttataagggatatggggaacgcatggggcgtccatccggcttttgcgtggaactgtaccataaaataccattccgcacgcgcccctatgaaaaggggatgcagcgtatcatggagacagccttcataaggaattccttccaacatgtgaggaccatttccattgaaaaccgttatgttttcatggcggcccaggcagcataccactatacggcagatgaacttttaataagggaagtcctggacctgtatctataccacaagacgtggagggaggaaatgaaccgggagtatatcaccaaccggctgaaagagttccagattgatggactggctgaaaaaatcctgcagattgcctatatgtggtttggttcaaaggaggatatcctgggagacggacagcccgatgatatgggggtatatgatgtgctggagaaccggatcctcagcagaggggcaatcacccgggagacagaccatcaggccctgcgcctggcatccttgataaagcaggacattgagaaggagagacgaaaggacaggcgggcggtattcatggaacggctggagggttacaggacggcgttcatgaggaaattccgttggcttttccctgaattcagatatatgtgcgccatctatcctttcctggaaaagataccggtactgctgcctgtctactgggcccgccggggaatccggcttatggccggccttctggcagggaaggttaaggataaggatacctatgagtaatcataaagatggaaatagagctggaaatcatggttttccagctcagtatgtatcatgattgaggagatgctgacgcaaagcgtcctgaagcgaccggaccgaactcttttcaggagcaagggaggccttgttcatcctctccgcctcgaacagttcctcacggacaacagaaacctgttttggcgcctcaattgcaatgcggaccccgctggaagcgcagtccgtaatcgtaatccggatgtcatcaccaatcaggatgctctcattcttttttctccgcagtatcagcattcccatcacccctgtcatttatatttggcgtccctgccatgcctggaaaggaacttatctcatggcggtaaccatagccgggattttcaaggacgacctgttttccgctccgtgtctgtgggttgattgcaagggggcatttcatattgaccgtattctcaaggtagttgttccgtattacacatagcgcatagtaagatagttccccgctgtctgacacatctaagcaggtaagatcttcctgggaaacaatgggggaatagtccggggacaggaatgcagggttgatgaccacaaaggcgacctccggctgttccgtggactgcatcagaatcagggacccctcgtcttcactgagacagatcggaagatagtatttcagattgggaaagccgaaaaagccttcggtgatggtaaccaggtcctcctggtcatattccacctctccataataatcagtctgtatattcataagtttcatgactcctatattgataagttcatattgattcccgaggaatcctcgcggggaggaatataatgaaagccgccggtatattcaaactgtatatcggggtattgtgtgacaatggtcatgacaaggggcggcacataggaaagctcgccttttgccacacgcagttcaaaagaaccgcgctgtaccgcataagcagccgcggcttctgccggaacctggacagaggcggtatggaccggggtatcggaaccatcggatatagccgcctttgcagaagccggagaggcggtatccccatttggaacggaaactgggatggactggccggtcctttgtccggaaggcgccagggaaatcttaccgccctttttaaccattgccccatgtccggtccctgccatggggccggcaacgggggctgccggatggcttgctttggtttcttttgaaaaagcagcattcacctgattcaggaaatcgtagtccacacaacctgcagccctaaaccgggaccggaaggcctggtggcgcaccaatgctttatgacgctccaaggccatgctgtctgccggaaccaggcgtgcgttctgggtgaagcggatggcttgaaagggaaccgaagtgatttttataagctgttccatcatgggcacctccttccgggcattaaaaaagtcaggaaatcagctgtatcacctattatttcacaaaatcaaataaggaggatgacatcatgttagatccgacccggagggccgcgttgtaggactgctggtaagaaaacatctcagttatggcctcataggggtctgctcccagttttgttttatactgctccgtcagggccagcttgatggtggtcagcttttcctcggttgattccagaagggaatacttattgcccaggtcgctgtatacggtgctgaccgaatgctctgtttcggtcattgtatccatgattgaaacaagggcagaggagaaatcctccctgctccccccgccaatatagttatcggaagcaatgacagccttgcccaccagtgcaatgggaccgttgttcagcctgtttatgacttcgtcccttgcctggctgtccggcattgcgttcaaagcgctggagggaagtccggtgatgaggttaagaccgcctgtattggtgtccagaagcgtttcaggttccgagatgttgccatatcccacatccatataaccggtctcacgcatggctttgacgatattatccagggtttcatcactgtccgtaccagtaggcggattgcctttggtgccgctgaattcatattgataggtcccgtccggctgctgggtcagtgtcatcaccattttggtgacactgtcatcacctgcaaacgtatgggaaaatgtcagctccctgccatctgcacttagggtgaagggcggggtggtggtgtcgctgccgccaaaaatgtaattattctgatactgtgagtttaaatcattgaccatggactgctgcttctggagcaggtcatcccgcactgtctgcacaatctgcatatcactgttattgctgtcagagcggatatactctatctttttcttggcctcagacagcctgttctgaatggaacgggccccaagctcctgctgatagagccggttcttcacattggtaataagcccaagcttgctcagggtgtcctggtactgattgtctattttcttgccttcatagtaggccaggggattatcggcagcgttttcgtaagctttcccgctggataccttattcatgcttttattcagcctactgtgtacatcattgatggaatttgtaaaattccggtagtatgatgaattagtgacgcgcatattgttttatacctccatcattcggttctatttatcttcccacaaggccggtaccgctgattagcgtgttaagtgcttcatccaaagctgtcatcagacgtgaggcagcattataagctgaaagataggtcatcatattggacgcctcttcatccaggctgactcctgacatggaatccctggaatcctgtatgctgtttaataccgtcacattggtcttaagggcgttgatattgctgctggagtcattggccagtatggtggatatattattcatatagtctgcaaaggatttattccccaattcagggtgggcctttttcatgttattaagcatggacagaaccgtgtccttggaactgccatccttttttcccagatgtacggttccattaatccattctttgctgataccgatggtcagggcagtgatatctgcagcagggtcggtcctgttggtgagcagttcgccctgaccgccttcggcattggcttcgtttatgattttcgcgaaatgggaggccagttcatccaggcgtttcatatagtactgatagcccctcacattatcctggacagaagaaccgggtgcaaccgggtctccggtgcctttcttgccaagcatatccaggctggcctgtatggagcctgaggcgagctggataccgatggcagaggctgatttggcagtctggccgctggaagaggcaggggtgaattggatggaaacagcagtggggtctgaaggattactgcccacgggggtgagcctgccatagttgctgccgagcgtgccttcggtgccgttgataagggtaagcctgttggtggtgccctcggggtcggtagaatccctgtatacaagctctaccttaagatcatccggccactctttcctgccgatgatattgcctttggaatcataatggtaaagctctttgggggcatcgatgatattgcctgaaaccgggtccgtcatcttaccgtcgtgttccgcgtctttaaaataagtcacttcgatagggatgtagctggccagctcatccaacaggctgttccgctcatccaacaattccaggctctgctgtccaagaatctgattctgtttaatctggtggttcagattcccaatctgacgcaggatgtcattgactttatccacggagccctgttcgctggtgcctgttccgtccagcttgctcaactctgccttttcggcagcttctatctgacgggcagcatcgttcaggaggttggtgagggactgcatacgggaacggagttcgctctcatacacagagtcattgcctttatcctgcagattgctaagggtggactggacatcgtcaaatgcagtacggattccatcaatgttgctctcgtccagggctttggacagagtgtccagggctgactgcagggtatcggaatatccggatttgttaatctgggccctgtactgggcatccagataggggtcacggatctggctgactttatccatgcttacaccaaagccaactgcaatctgggaaccgttcatataacgggaaatgggattgctgtaattcaggctggaagtctcaagctgctgccgggtatagccctgcgtgttcatattggaaagattctgtccgactatgtccaaacgtttctggctggcctgcagggccgagaaagcagtggaaaagccggaaaatgttgctcgtatcatatggtatcatcctccggattgttgttggtggcggtaagtgtccgcctatacgtatcggtcgtgaaaaaaagaagaaggtcctttggcagtcctgccgttttcatcgtacacctcccctgttgtgctggataggatttggctgaattccctgagcctgacatgtatcatccgatccgcggtatcctttacctcaaggagatgcttaatctggctgtccagctgggtgaacagcggggagaggcggtcagcctgttctacggtggcctggttcaggatctggcggaaggcaagccccttaaagctcatggcatcagcaagccgcaggcgtttctgctccagtcccctaagctgtaacaggtagacctgttcacgtttaaggataccgtccatcctgtcatgaaagcccagggaagctgtttcggctttctcttcctcaagccgggcaatgtcctgaatggtatcggtaagctgttcaatggagcgggcaaattcctccagggtatcacttgtgtggttctgattttccatgcttttattctccttaactaacggtagccaagtaatttctcagcgatgcgtctggcgtccggatggtaggttcctgattccacctgctgctttaaatacaggacccgctcgctgcttacgccgccttccagcctggctgcggcctcccgggcaagtacccgggcaaaggatacatcatcttcgggataaggggacctgttaagcgatatcttatcataattgccagcttccctgccggcaggcgtattctgtgtgttggtagcggaggtaatggaccggtagtccggataatccgtattgccggtataaaatttgatgttcatgacaccctcctttcatttcatgtttctgaaattggattccttttgctgctatacgtatgttatcggcgttttttaaacggggataaggaagttttagaaaaaaagagagaatttttttaaaaataaccctaatggttatggcagaacgcgccgatatataaatagatatggactgaatttctaagtatagtccaatacggaggtattatggctaatatcttacaggtaaccggtccttccctgaatccggaccacaggaacatatcggacagccagagggctgcggagtatggggacagccagaaaatccagaatccggtggatccgtcccgtgttgtcagggcggacgggcagaaggaagggaaaagcggggacgccacaggagaaagaagctatagcataattgactatgaaagcaattatggagctttcataaagaatctgggggaaggcatggaacttcccggacttttggaacagcttttttccagggagatggccggactgctgtttggtgaccagtcagaggttggggaactggtagagaggcttctttcctctgtaaaggcggagtcgccggaagaactgctttcattccttaaggggcagcagctttcccaggccaagttttcaggccctttttttgacggactgaggaacgtactgttccaggatgcctccgggaatatgaaggaagcggtcctggcctttttaaagacatataatgattactcttcaggaagccatttccttcagcagatgcatacccttacagacgatataagccatctcctgatgaatcctttcagggatgatttccggcagcttatggacggcatggactgggaggctgccaatggagatacggcagccaatacaagcttcctgaatggcaggctgattccattcctttccaattatatatccaggagccacgattatggagcggtgagggatgctgtcatgcatctgattttccatgcggtgcgttatgagaacggaaacctggacaggctgcagcatttgttcgaccgtgtggcggaaagccgcggtgtggagcgtttctttaaggataatacaatgcctcctctggacagcatattgaatgcccatgggcagaaggaaaagggagggtttgcggacgctttttcttccctgctgttaaagggggcgggcggtgaggcgggagtggagaatatccagcagttttatcagatcatgaacggcatgcttctgaatgaaagcgtataccttccgcttctgcatatcctgttccccttccagtaccaggggaaggatgtgatgtcggaaatctgggcggatccggatgcaggcagggagggagaggatgggggcaggaagataaagatgctgttccactttgacgtccagggattgggaaggtttgaaatgctcatggtgttccgggaccgggtagtggatatgcagcttggagtgccgcctgtccttgccggccggtccggggacatccaggagcacgtggccggaatcatgaagaagaacggtctggatccgggccgcctgctggtaagggaaaaaacggataatctgaggattgaggatgtatttccggaaataagggataaggagaggaccatcaatgtcaggatttgaggaattgatgaaaaaaaaagccgttgcccttaaatacgacgcccagaaaaacggggcacctgtggttgtggcttccggcatgggatatatggcagaaaagattacggaagccgccatggaagccggggttcccgtatatgaggatgattcccttgccacgcttctaagccagatgaaactgggggcagccatccccggggaactttaccaggcggtggtggacatatacatatattttcttggctttgtaccggagggaatcacggatggccgggaaaggcccggcgccgcaggccaggatcatattgaggataagatataaggagggacagcagatgccatgcaggtggattaagggggcggcagctatcatattggcctgctgccttgcacagggtggcgccgttacatccatggcagccaccaagcctattaagacagtcagcgtgcgggtgaattcaaggctggaagccggaagcaccctgccagacatagagattggaacaggaaacccggaaaatggaaaggtgcgggtgtctagaggcaacagcaagtaccatgtctccagggcagaatgggtggataaggccggggatgagctgaaggcagcggatgagcccaggatgaaggttacgctggaacctgaggatgtgggggaggattatttccttgcaagctataagtcctcggatgtcaaggtcagcggaggtacgttcgtatccgcaaggcgggacggggacagcctggtggtgacgctcagggtcaatggtgtgaagggggagtatgaccctcctaaggatgccttctggaatgagaagaatctgggtgaagccagatgggataagccggagaatacatccgggtattatgaggtccagctgttcaggggcgggaaatctgtccacaatatatctaagacatcggcagtcagatacaatttttatccgtatatgacaaaggaaggcgattacaccttcaaagtaaggaccataccatcaacggatatacaggtgaaatacgggaagaaaagcgaatggattgaatccggggagctacagataacggaccggtatgtatcggatggcaagggacagcagaaaaaggacagtaccctgacccgtgggactgcggatacggttggctggataaaggaagaagagggctggcgttaccgctatccggacggcggtctcataaggggcggctggggactgattgatggccaatggtattattttaacatggacggtcttatgcttaccggctggcagaatgtggacgggcggtactattatctctatcctgacgggcagatggctgtgggatgggccaggattgacggaagatggtattatttctccaccggggaagaggccggggaacccgcaggctccatggccggggccggctggaaggtgattggggcatattattattattttaatgaagacggctccctttataccggatggctgtccttgaatggcaggaagtattatctgaacacggtggacaacagccttcagggagccatgttcaccggatggatcataagggatagccagaccttctatgcggattccaatggggagctggtggaaggctggtgccagatagacgggaactggtattatttttatccgggttcctatgagatggcaagagatacgcagatcagcggtttttatgtgaaccaggatgggatatggatacggtagcaggaggtggttcggattgaagaaaaataggatgatgaagacggccctggggctgggcacagccatgactgtttggatggggctgtgtgcctacggtgcccagtccagcgtgattgagagtgtgaacgtaacctttaagaccgtctatggggagccggaagagataccggagccggaaatcacggtcagcggtaaaagctgcttctttggggatgtccagtaccgcacggattatgataactggaaaccggggcgcaaggtccgggtggaggtcacggtggcggcggaggacggaaaatacttccccgccaccctgaaccggtccaaatgcaaggtcacgggcgctgactttgtgtcagccaaagccctggatgattccagccttcaggtgaaggcggattaccggccggtcacggtgctgggagatacacagaaagcaggctggagcggtacggccaaaaaaaaggccgtgtggaaatccgtggaatacgcgccgggttatacccttaccctgtacggtgataataaagtagttaaaaggatgacagtggaaagcaacagtgtcaatctggccgactatatgacggacatggacaaaacctattattatgaagtaaaggcagtgcctgttacctcggatgagaagaagtatctgaaggaagggcagtatgtgacttccacggaccaggagtttgactgggaggattacgagaaggaagaaaagcgcagccagggacctggggacggtggttcctttaaaggggacaattatgtgatgccggacggttcaaaggcagttgacacatggaagcttgtttccggcaaatggtactattttgacggcagcggaaaccgggtaaagggctggcttcatacaggggacagatggtactatatggaccagaacggcgccatgtgtatgggctggatcagccccggcgatggattctggtattatctgggagaaaatggggacatgcttacgggctggatacagccaaaccctggaacgtggtattatctggggactgacggccggatgcagaccggctggatgaatgataacggaacctggtattatctggacagcagcggcagcatggctgtgaaccgcacggttgacggctggaacataggtcctgacggaaaggcttcaaggtaaggcatatcaggatgaaaggagcaggataaaatgagtttaatcacatcggcggcagaggcccggaccatcatgaggcaggatggaggaaacgccggccgggtttcttcacaggacaactccttccggagtgtgttaaagaatgggatttcaggcattgcggaagatatggacaccatatttgaggaggcggcggcaagattcaatattccttccgggctgatccgggcagtggcaaaggcagaatccaatttcaaccccaaggccgtatcccatgccggagccatgggcgtcatgcagttaatgccgggaacagcccggggcctgggggtatcagatccatatgacgccagacagaatatcatgggaggcgctaagtatctgaaggaaaacctggaacggtttggggatgtaagcctggccctggcggcgtataacgcaggaccgggaagcgtccagaaatatggcgggatccctccctataaggaaacccagaattatgtcaaaaaggtaatggcttatatgggagagcctggcctgaacgctggcaggaccgtcaccactggaactggcagtgcttttcccgccaggggagacggcctggcgcttagctatctgtacggggggaagttaaccggaaacagcctgactgcgtcatctgcgtggatggataacctgtccgtccggcaggaaggggacagcatagtcatggacaaggagagctttgccagtctggtacagatgatgcggatccagatgatgatgaatgcggaccgggaagtgggagcgctgatataagggcagaaggagtaacggatatatggtgttaaaagattgcagcagatgtatggtatataaccaaaaggggcagcgcctgtcagaagcaagggtcgttcacgtaaaggacagtgtttcactgttcttttctgattataagtttcaggattcacgtttccaggcaagggtggatttttttgatgaccaatgcggcctgattgtaacgaaatgtgaggtcatcatacgtaggaatccagcatacatggaaacaggggagccatggaccgcagactgccgcatcctggatgtgaagaatgtggttcagcgtcagagggatatacgggccaaggtatatctggaggtggagtttgaactggggaatgggagacatttttatggtacaatccgcaatctcagtgcgggaggattatatatcaccacggtccagtctcttaagaaaggggaggtcatatccttcccttattgtttccgtaccctggagcggaggttccatgtgtgtatcctttgggtgaaacgcgtggagggcggaagatacggatatggatgcaggtttataaagctgacggacggagccgaggcagccatacgttcttttgtctataaaaaactcctggagaagagaaaggaccttacatgaagataaatctggtgatgattgtcaggaatgaggaacgttatctggaacgctgcctgaaaagcgcagtccatcttgtggaccacatggtcataaccgacaccggttccacggacaggacaaaagaaattgcgggcagcatgggggcgctggttttggaatatgggtggaccgatgacttttccgctgcccgcaactttggactggaccattcggacggggactggaacctgatcctggatgcagacgagatgctgcggttttgctctaggaaagcgttggaggaacggatatccaggctgtcagacagatacggacaggcgtggatgggagccattaccagatacgattcctatcttgacggcgacgggaccagtgtcagcacatccctgattccaaggtttcttccaaaaggcatccggtattccggaatcatccatgagcagccggacacaggaatcccgtgctatcctctgtatctggaggcggaccatgacggttacatcaaccgtgacaaaggggagaggaaccttccctatcttgagaaagcggtcaatatgtacccggaggacgtgtattacaggttccagatggcagccaccttgcggaacatgaaacggctggaggacagcctggactggttccgcggcttttatgaaatggtgcccccacaggcaggctaccggaccgagggtgtgctttcctacctttacaccctgctggacctgggcgggcctgtctgtcttgatgaggcatggtgcataatcaggcgggagaagcccgtattgggaaaaagggctgatttctgtttcctgtgcgggcttttttatatgaggctggtgttgtcggacgtgaagcagtactatcatctgctgccggaaattgaaagcagttatttggagtgtctgaggattggggaacacccggaacagggcggcgtggttggcgcaggttcctttaaggcggcctataatctggggctttggtatgaggtgtcaggcaacagggagaaggcgggggagtactacaggcagtcagcccttgccgggttcgggccggcctgggagcggcttgaggatattttggtcaaaccatcagatttttcttattaatccggcaaaaacgccgatagacatagtaaaggaattgaaaagcatatcggcagcgcccggataggtgcagggcggaatatagacggaaaggcggagtggacagatgcagatacagaacaacatagcatccgtgaattcatccagaaaccagaaaatcataaaaggtaaattggataaatccttagaaaaactgtcgtccgggtttaggattaaccgggcaggggatgatgcggcaggattggccatctcggaattgatgcgcagccagataagaggtcttgaccaggccatgcgcaatgtaaatgacggcgtaagcatgaccaatacgggggaaggcgccctgacagagattcattccatgcttcagaggatgaagacactggccgtacagtccgccaacgggacctatagttccacggccagggaaaatatcgagtcagagcggctgcagcttctggatgagattgaccggatcagtcagaccacggattttgacggtatccctctgtttaaggagtatcccggcgatacggtccccgcatggtttgaaccgccggagaaagaaggggatatcacgctccagatcgggcattcgcaagccgagaccctggacgtgaaacggtattatatggggagtaaggaactgctcttaaaggatatggattttaccactgtggacaatgccaaccaggcagtggatacgattgaggatgccattgaggccatatccgatgtgagggcgtcctttggggcatccttaaaccatctggaacataccaacagcaaccttggtgtgacaaaagaaaacatgacggtggccgagagccggatccgggacaccgacatggcggagcagattacagcctataccacggagaatatcatactccagtcatccaattccatgatggtccacgccaacagcctgccggatctggtaatccagctgttacagggataaaggatgaaagaaaaagtataaaaaccccttatatatattttaaaattgacgatattcaaaatgtaaggcaacataatataaatagagctttgcagatacgctccataaagggcccttatggacgtatgggcggggacagggaggttcctgccggatatatttaaaatcaaggaggaaatatttatggtaatacagcacaatatagcggcaatcaattcttacagaaacttaggcaccaaccagagtgcattgaacaagaacctggagaaactgtcatccggttataagattaaccgtgcaggcgacaacgctgcaggacttgctatttctgagagcatgagatcccagattaacggattaaaccaggcggcagccaatgccaacgatgcaatcggcttaatccagacagcagaaggtgccttgacagaggttcactccatgcttcagcgtatgaccaccctggctacccaggcagcaaacggtacatacaactctgttgcccgtggtaacatccagtccgagatgaacgagctgatggcagagattgaccgtgttgccaacaacacggacttcaacggcattaagcccctggagaataagaacggttattccgcaaatcctgatgcggttggaggtgccattggtggtaacagacctggcagtacccacaagatgaccttccagattggtccgacagccggtgaaacaattctggtcagcggacagtccatgacggtttctggtatctttaatgctaccagggcttcttatagtactatgaccggcagcactgttgatgaaaaccacatcctgtatgttgggaaaaataccacaacctacgccaacagggccatcactgctatcaaatcagccatcgataccgtatcttcctaccgtgctaagctcggtgctgcgcagaaccgtctggagcacaccatcagcaacctggaagttacttctgagaacatcacagcagctgagagccgtatccgcgatacagacatggctgatgagattacaaactacaccaagaacaatatcctcctgcaggctgcccagtccatgctttcccaggcaaacgcagctcctcagggcgtattgagcctgttacagtaattctttaacagcggttggtactggttccgccctttcaggcgggactaccttaagaaaaagccatttcaaaagcaggtagctgagaaatggctttttcctttacagacagaaggtatggaggcattatcttggagaaacagggcgaagtgtgtatttcccagtgcatgattgtaaaagatgaggaacataacataaggaaagcactttcatggggaaaagggattgtctgcgaacagatcgtggtggacacaggaagcagggaccatacggcccagatagcagaatccatgggtgccaaggtctatcattatacctggaccgatgacttttccgcggctaaaaactatgcaatcagcaaggccagaggggagtggattgcattcctggacgcggatgagacattcgctccgggacatggggaaaagcttccggggattttaaggcagctggggcctaccagggcagagggggtagcggccggatggatgcagctggatgaagatggaaaggtcagcgccgcaggaacccagatccgcatcttccgcaaccggactaatctgggctaccgcaggaggatccacgaacagcttggatggatggacggaacccccatgcatgttgctgacgccacaggggagctttccattctgcacagcggttacagaggtgctgcgtgggaggataaaaaggtaaatggaaggaacctgaacctgattcttaaagagctggaggaccatcctggcgactatgagatgatggggtatctgggggatgagtattatgcggccggggatttggataaggcggagtcctggtacagggagtccatagcatccatgccttccgtgttggacgggagggaccagagaagtgcggctacttttacatatcttttgcagattatggaagaaaatgggaatgaaatcgatgaaatgcggcctatttatgaaaaggcttcggaaatccttccaaaggaagctgattttgattatttaataggtaaatatcttgcggctgacagggattataaggaggctgtattttacctggaacaggctttggacaagtttcaaaggtacggaagttataaccgggccatgctcatagggagccatttgcgggaaacatatgaacaactggcccgttgctgcaggaagactggaagagatgaaagggcggtgagcctgtgcattgccgtactcaggtctgacccctattccatggaggcgttgtacatcctgctggaagcattcaggggaaatgggccccgtccgtccgtggctcctgaaaaagccatgggcatattggaacagctgtattgtctcgattcgatgaaagacaggctgtttgtcctgaaggcgtgctctaaactggggtggccggagcttgaggcgtatataaaggagcggtttacagcggaggagctgtcatacatccgttccgtatggtccggcgccatatctgcctgtcctgaagaaaagacgcaaagagagggaggaacgtaagatgcgatgtgcagatgtgcggctatcacaatgcatgattgtcaagaatgaggaaaaaaacattgagcgggcattgtcctggggaaaggacattgtgtatgagcagattgtagtggacacgggaagcacggaccggaccgtcgagcttgcccgggccatgggcgcaaaggtttatgattttcaatggattgacgactttgcggctgctaagaattatgcaatcagcaaggcgtctggggagtggattgcctttttggatgcagatgagtattttcctccggaagaggctaagaagctgatgccgttactgaacaaactggcgaggacacggtattatgtcatgcttacatcctggatgcatgtaggccgggatgagaaaatctttgcaggcggcgttcagacacgtatctttaagcggatggagggcctgcggtataaaaaaaggattcatgaggaactggaactggacggaggcagtattgttaactgtacggtggatgccagcaatgaattagccatcctacatagtggatatgaccttaattccagtgaggataagcagaagggggaccgcaatgccaggctgatccttatggaattggaagagcacccggacgattatgatatgatgggttatttgggagacgcctattattcaattagggataatagcgggagggcagaggaatggtacaggaaatccattgaccggatgccggcacatattgacgagtacgatgtcagaagcgcggttactttctggaagctcatgacaattttatttaaaaagaatgatgagcaggccatgatggaaatctatggaaaggcaatccggctgattccgaaggaatgtgattatgattatgttgcaggtaaattctatgtgggaaaacaggatttcaaaaaaggcgcataccacctggcgagggcgctgcagatccttgagaagcatggaagcgttaacaggggtgaacttctcaccggcaacctccagggaacatgggaacttcttgccatgtgtcattatcagaacggggaacttgacaaatgcgttaagtgttgtactgccctgctgaaagcggaccgttaccttatgtcaaccctggtcatgatgctctgtgcctttaaatgggatgaagagagggatgccgctaaggccgctgatgccgcagacgtggccatgttccttggaaccatctatgatatgaacagcttaaaggaccgtatcttcatcctgcgggccgccatgaaagcagattacgggaatctggtgaaggtggtcaggggcacatgttccagcgaggaactgtactgctttgaccgctccatggaacaaagaggccggcagccttaggaaggcgccggctataggattgccatatgatggcggaactgcacggagtcacccattatcttccgccccctgcccaaccgcccacaggggcgcgccgttgtcatgacactgtttcagttccgacataagctggactaacttccattcttttgtactgttctcatagctgttgggatccgctatgcgtacattcccattgttcaggtactctgtaatcaggataaaatgcccgttatccgtaagggccccctttcccataagcgcaatcaggatatgtccgctgtccagcagtccggctgcattgccaacggtccggtgctgtacgctctctacgtggattccatgggctgataaggaatcctgtatcagattatggtaggaaccgccctggggagcgtaacagccattgtcagcagcccattcagcggctgatacaggcgtggtgggggtggatgagaagctgttgattatcatggcaacggcagtggggccgcagccatatttcttcatggggtcctggccgccgtacagataatccccccatctggcgtcggcctggttgtagtaaagcatgggccccatggcagtgttgagcatgacggtgtaggtggcttccttttgttccggctccttatccaaggacaggtcatccagacttcccagttcctgcgacggttccaggtaggggatggacggggtgtcaggttcggacaatccattatcatcctgctctaatccgcccgttctggcctgcgcggcggaacgggaagtatcggataccaggccgtcggatacaggggcagatgcctggccggatatgttccggtacaggcggcccgcctttttaagcgcagaaggccccacatagaaagaaaggctggatgtcatgatcagggatgatataaggataccggattggatccaggatgcgtaagaaggcttttcctttctggcttttacattttttctttttttcatatctttgtaaatggcccgtctcagggcctggatagtctgttcacgaccagctgcggaatggactgcaggggcgactggacacagactgccccaattttgtacgcctccatgggcattccatatacgacgcaggtctccctgtcctgaccgatggtataggccccattcttacgcatgcgcagaaggccggcagctccgtcagcccccataccggtcagcaggatgccgatagctttattcctgacagtttgggaaacagagtcaaacagtacgtccacggaaggacaatgtccattgaccttttcgccggcactgcactggacggcataacctgtccccatgcggaccaggcgcatctgctggcctcccggtgccagaagggccagtccgggatgaagccggtccccgccttttgcttcccggacctcaagattacacagccggttcaggcgttcggcgtacatggccgtgaatcccgggggcatgtgctgggttatgacaatgccaggcatattctggggaaactgctttaagacttccagtattgcctcggtgcctcccgtggatgcgcctatggcgatgacggtcccattgtctgattccggtttgaattgtgacattaccttgcctgatatacggcggctggaagtggccggggctgtctgggatgggggaatgcggatcttggactgggaagccacaatcagtttggaaataagcatggataggaatgcatctttacttatatggctgttcatgtccggcttccggacaaagtcaaccgcaccggccgccagggcatcaaacacctttatgttgagggaggataccagtatgaccgggagcggatgcctgggcagcagctcttttaaaaaatcaagacctgacattcccggcatttcgatatccaaggtcaggacgtcaggtttgaggacaggtattttcttactggcatcaaaggcatctgtcgcatatcctatgatttccagatgttcatcctttgagagctgggtaatcagccaatttctatatactgctgagtcatcaatgatcatcagccggattttacgttccatatcatttccttctttctggtaattcagtgtaaataaccgttaccgtgccttgcggtaaatggcaggcatcaggtattggtaggggcattctgtcttgttaaggctttctgaatgcccgataaagagatagccgcccggtacggttgagttataaaaacgccggaccaggccgactttggtgggctggtcaaagtatatcatcacgttccggcagaagattaagtcaaaaggccttctgaaacggattgggtccatcaggttaaatgtcttgaatatgacgttctgcttaatggccggggcaatgcagtatgagccgtcccctgatttgacaaaatacttctgtttccaggattccggtacacgggccaggctttcctcctgatagaccggattttgggctgtgtccagtatctgctgcgatatatccgtagccaggacacgggtatcccagcatgaggcctgggaaccgaaaaattccttcagatacatggaaatcgtgtaaggctcctcaccggaggagcagcccgcgctccagatggaaaggacccggtcctgttcatgggccttggcaagattgggaaggaccgtatccttaagatacttaaaatgggcctcttcccgcatgaaatatgtataattcgtagtcagcttattaagcatgctggttaccatatctcggttctggccggatatgatttcatccacataaggtttaaaactggtgtaaccattggctgtaagcatgtttgagaggcggctcacaatgagctgcctctttttttcaaggtcaatgccgtaattttttttgatataggtgtaaagcctgtgaaaatcttcatcacttaaagttaacatagttggactcctgtgggatatcttggcaattaatactggtagctggccagcgcgtggcagtcaaaggacatcagaacgctgccgtcttctatatttatcatgccgtccagtagcttctgctgccgttttacaggaataggccgtacattctggaaattgatgtccattacctgacggacggaatctaccacaatacccagggaagtggaatccacgttgaggacaacgatacatgtcttattggtatactccacctctggcttgcccatacagagacgtatatcaactacaggaagaatctgtccccgcagatttatgattcccttaatgaaggaggggaccaatggaagaggggtgatggcataagcgtttatgatctcaattacatattttgtactgaggaacaggacaagaccacctgaatcaaaggtaaggcagcgctccactgaatggttcatatcctcgttttcctgttcctgtccaatctggatttcgatttgttctgacataattcatccctccgcgtgttatatgttttcaatggcagcagcatgcaggctgagtatatcaagtattatgctgatatttccgtcacccaggatggtgcatccggttatgccgtaatttttaagttcaaagctgtttaaataggttggcagcggtttgaccaccacctgctgctcgcctatcaggtcatccacaaacaggcagtaggagcggtcgctggcctctacccaaagaaggatgccctcttccatggaagtgacctccgtatccagacggtagaagttatgcagccggataattggataaaagctgcccatgcgttccaccatctcgttgccgtactcatcaaggatgacctgttctgccctgaccttgaaggattggcggatattcgcgatgggaatggtgaaaatggaatttcccaccgtcaccttcatgccgtccacgatggcaagggtgagaggaatcttcatggtcatcgtggtgcctgccccatcttcacttgagatggacacagtgccgcccacggattccacattctttttaaccacatccatgccgacgccgcggccggagtattccgttacggcctgattggtggaaaatccgggaagcatgatgagacttaaagcttccttgcgggtatactcactttccggtttggtcagcaggcctctttccttggccttggccaggagcttgtgcgggtccatgccgtacccgtcgtctgacacggatatgaccacttcgctgctggtgtgggaagcggacaggacgatttccccctgtgggtccttgcctgccgagatacgctcctcttttgtttcctctatgccgtggtccatgctgttgcggacaatatgcatgatgggatcctggatgctgtccactatggttttatccacttccgtatcttcaccgatgatcttaagacggacatccttgccaagcttctggttcatgtcccggacaatccggttcatcttttggaacacgccggatatgggtaccatgcgcagggacatggcaatatcctgcagatcatccgtaagcttacgcagctgccggccggatttcatgaagttgtcaaagctgtccctgggaaggagattcagctcgggtgatgaggtgaccatggactccgttatgacaatctcacccactatatccatcaggctgtctaatttcatcaggttcacactgatcagattttgttttaccggagcgtaatttgtctgcggggtgctgccctgggcaaaagaacccgaggtggtctgcgcggaagcagaggctaagggcgctttgccttcctgtccagggacggttgcctcctgattcttcccttcatcaggagaagaggacacctcaagcaattcataagaacggatatggttctgtgatttgatgatatcctcggcctggacagcagtttcgcggttgctgaaggtcaggaaaaatccttcctctacaatcgtctggcaggtatccgggttactgtccatatctgcagggtaataattgaagtccagttcacattcctttagggaattagctatcatataggcacggaggttttccatacccactccctcttccaggaagatgtggagatagcacaccgcatctgaatccgcaggaaggggcctgctgcctgttttttccgtcccgtttttggcgtcagatggggaaatgccggatccgttggtttcagggttactgatttccttcaaaaaaacattgatttcaagagcaaaagaatccagattatctgacaggggggcgccttgttccaccttttccacctcacttctcagaaaatcctctgaccggaacataagattgaaaagttcttttttctgttcctggttcagggattctatccctttgtcacggatatagaagaataaatcctcgatatgatgcgcgatgacggagagggaaccgaattccatcatggcagatgaccctttgatggtatgcataatacggaagatttcattcacatcatcggatgaaaattccccacttttttcgtctgcaacaagcatctcatctaactggtctaatagggaattggtttcatacagatacgtatcaagcatactttccataccattatccattgtgcttacaccgccttttttatatttaatcataataaaaccataattatttaatcggcacaaaagataaaagcataagggaaaactgtacagctttgaaattatattaaaatgttgttatattgtggggcaaaatgccgatatacatattatggaattattgagaaaggcggaaaaagtcatgcgggaatatatgaaacagcagatgagggacatgctggctaccctgggaagggcagaagcaatcctggattccaggacaaagaaaaaggaagccggggatattgcccagctgcttgaagatatgcaggcatcagccatggcaatcggcacagccatcgaacaggtggagggggatggcacacagaccgtgaggtttctggaggagtactgtgaactcctctggcagtacatggtggaagaggacctaaaggcgcggttctgcaagggaagacagctggcaggcaagcggggggagatatgcaccagtctggagcatgagtttgaaacacgtctggaaattgttttcctcgtgtgcaggagccaggtatggaagcagatggaacgtttctatcatcttatggaagaaaaggcggactgctgggtacttactgcatcttataaggaagtgactgacctggaggaagggaccgtgatgcatgatgaatcaggactcatacccggggcggtcaggcccatgggatttgggcagtatgacatccgggaaaggaaaccggatatggtgtttatagacggcccttatgcacagcagggccagttgggaatccagccggattatgatttcatggaagtcagggagaacgcgggaatcgtgctgtacatgccctgttatgaggccgacagccaggcagaggaggcccactgtctgataccacaggccgtatgttccgatatcatcctggtcccctcgggaaggataaatgaaatatatgtgaatgccatgaaccgtctggataatggacaggacatgataaagaaaatttatgtattggatacgcaggacgtggatagggcgctttcagatgtgctgaataaaaagaaatgaatcaacggaaaggagatatggaagagtggacttactgactggaattgcattggccagcattgaccttaagggttcccgtctcatgacggatatgaatgtgacaatgttaggaaagactttggatacggcccgccagcagggacaggccttacagcagatgatggaatcatcttctccgccaatggggagccagcgtctgttagacgtatatgcatagtataggagatagggaatgaatatgaggaatcttaatattgctaaaaagcttacggttgtatttgcaatcatcattgtatgtttctgcattgccgtggttgccataactttgggaatgaacagcgtgggaaacagttatgaaagcttttatgagaacagccatgaagccatcgtacggtcttctaatatacagaaccagcttcagacagccatcaagaacgtttcattagccacagtggattcggatgcaaataatacaaaggcttatgtgacagaaacagaaaacagcatgaacatggtgaaaacagagctggaatggtttcagggtaattatgatggggatttaacccttttaaacaagtttgagtccaggatgaatgagattaaggatttaaggaacaggatatcatccctggcaatggaaaacacggccttgtcaaatgcatcggcacaggagctgttgacagaagaatataatccaaaggtgaatgaggctgttgaagatttaaaaagtttctcggattcagtggatgtcttgggggaacaggattataacagttccatccgtattcagaaattgcttcttgttgtggccatcttgctttcagtggcagctattgtcattgcaatcgttctggcccttatgctgatccgtgcgattgtgccgcccattaaggagatacagaagggcatggaggagatagaagacggaaacctggaaatccgcctgcaataccagtcaagggatgaattgggacagctgtcagacagcgtccgcggtatggtggattccctgaaaaccattatccatgatgaggattatctttttgcagagatgggaaatgggaattttaatgtccagacccgtgcagaagataaatatgtgggtaatttcacctccatccttacctccatcgtgaagctgagggataatctcaaccgcacactcatgcagattaaccagtcagcggaccaggtatcatccggttcagaccaggtatcatcgggagcccaggccctgtcccagggagccacggaacaggcttcctctattgaagaactggcggcgtctgtcaatgagatatcttcccaggtaaagcagaatgcggataacgcgcggaatgccagcagccgggtcaatgaagtgggaagtgaagcagctgagagtaaccggaggatgcaggacatgctggcagccatggcggaaatcagcagccgttccagtgaaatcgggaaaatcattaagaccatcgaggatattgcattccagaccaatatcctggcacttaatgcggcggtggaggctgccagggcaggcgaggcaggaaagggattcgcggtggtggcggatgaagtcaggaatctggcaagcaaaagtgcggaagcatccaagaatacggctgctttgattgaaggctcccttaaggcagtgcagaatggaacgaagattgcagatgatacagccatgtcactgaatgcggtggtgaccggtgtacaggatgtgacgggaaccattaatgagatatcagacgcatcggaggcccaggccaggtccatttcccaggtgaccctggggattgatcagatatccagtgtaatccagaccaactccgcaacagcggaggaaagcgcggcggccagcgaggaattatcaggccaggcccaactccttaaggatttggtcagccagttccggcttaagccttccggcggtccggagcatgaggcatacgccgagccgtacgaagcaggcaggcaggaaatccctggggctgtgtgcagtgataaatattaaagtatgaaaataggaacgtgacttactgtacccatgccggttccatgcaggaaatcagcatgggtttctttaccttattatttttgtaaataagccgataaagagattataaggtattaggaatgaaaatatgacagattaaaggagtgggacaatgaagagtatccgtatgaaaattgtaacaaacatgttcgttgccatactggtttcactggttgccgtaggcggcgtaagcgcatggcttaattacagcagtacgattgatacgttgagactgaccatgtccgagacagcagagacggctgcggaacgtgttgaaaaggaattgaaggcatataaaaatattgcatccatcacaggatgcattcctgtgctttcggaccgcacggcaacggtacaggaaaaaagggcggtcattgaccagcaggtatcggcacatggacttcaaagaggcaatataattggtttggatggaatcagccttttggacggcaatgactattctgaccgggcgtacgtgaagtctgcaatgaagggcgggactgcggtgtcggagccgctgattagcaagataacaggtgaactgagtatcatggtatctgcccctatctgggaaggaggtgtgcctggaagcaggattgtaggagtggtatattttgtcccaaatgagtcatttttaaatgatatagtgtcctcgcttcagatcagtcctaatggcagtgcctatatccttaataatgccggttatacgattgcacataaaaatatagataatgtaaaaaaacgggaaaatacacaggaagatgcaaggacagataagaaactgaaaggcctggcggccctggaagtgcgcatgacattggggcagtctggctttgggcgttatgagtatggaggaagcaaaaagttcctggcctttgcacctatatcggacacggagggctggagtcttgccatcaatgcgccggttggggattttgtccagtccaccatcaacggagtcatctttacaattatactcatggtggtttttctggccgtatccgcttttatgtcattcaggcttgcagggcaaatcgggcagccggttaaggactgcgccaaccggctcaggcttctggcggaaggggacctggatacgccggtccaggagatacataccggggatgagacacagatattggctgattcggccaggacgcttgttcagggatttggtcgtatgattcaggatatggatgaaatgctggcagagatgtccagaggaaacctggctgtggattctaaatgtgaggaagtttatgttggaggatacagaggacttctggactctgccagaaaactgagcatacagttaagtgataccctgcgccagattaaccagtcagcggagcaggtgtcagcgggagcggaacaggtatcagccggagcccaggccctgtcccaaggggcgacggaacaggcaagcgccatagaggaactggctgctgcgattaccgatatctctgggaaggtcaaagcaaccgccgacagcgccggaaacgtccatatccaaagcagtgaaacaggaagtgaagtggaacagtgcaatgagaagatgactgagctggtaaatgcagtgagggatataggtgaaagctcttcacagattggaaagattataaaaaccatcgaggatattgctttccagaccaatatactggctctgaatgcagcagtggaagccgccagggcaggcacggcaggcaaaggatttgcagtggttgcggatgaagtccggaatttagcaagcaaaagcgcggaagcatcaaaaagtacttctgtcctgatagaggggtctgtccgttccatggaaaaaggaatgaaaatagcggatgagacagcagcatccctgcagaaggcagtggtttctactgaaaatacggtaaaggcagtggatcagataacggatgctgcgacagaacagtccctggccatttcccaggtgaccctgggcattgatcagatatccagcgtggtccagaccaactctgcaacagcagaagaaagtgcggcagccagtgaggagctgtccagccaggcggtaatccttaaggaactggtagaacagtttataaccagataggtggctggaccatggttttgtatgattgaggtgtcaagggcctgtgcccaagacacttctttttaaatatatagtttgttgcaacaaactcttcttattgacaatttttcctattaagcatacaatgaatatggttttaaggatattacaggaggatacgggtcagtatgcagaggaaactgaatgagtgcgaaatcggcggccggtacgtggtggcaggggtacaggtggatgagggcattaccaggagattggaggcccttggggtcaacgaaggtactcctgtgaatatattgaataagaagggcagtggaagcgtcattattaaggtcaggggcaccaggctggctttgggacgccgtctgtcagagggaattacagtcagggaggaacatgcatcatgaatgggcaggccagagcagcaggaaaagattcatatggcagcataaccctggggacagggggtggatccatggatagggaatcacatgccggtaagccggaggaaaggaaaaacagtatgccggatccggtgcataaggaccgtaaggaaagcacacggcctattacggtcggtttcgtgggaaatcctaactgtggaaagaccaccttatttaacgcgtttaccggagccaagctaaaagtggccaactggccaggtgttaccgtggaacgggtggaaggggagaccagctataagggcaggcccattaaagtcattgaccttcccggcatttacagcctcacctcctatacgatagaagaaaaggtaaccaggaaatgtattgaggatggggaagtggatgtcatcatcaatgtggtggatgcctcctcccttgagaggaacctgtatcttaccatgcagctcattgaactgaagaaaccggtcatactggcccttaacatgatggatatcgtggaagagcgtggcatggagatagacatgcaccgcctgcctgagatgctgggggaaatcccggtggttccggtgtctgccagaaagcggaccggtctggatgtgctgatgcatgcagtggtgcaccattatgaagaggggccacagggtgtggtggtccattacagcgaagaggtggaaggaaggatttcacagattgaaaccgccctcagggaaaagtacggtgagatggataacatgcgctggcatgccatcaagttcctggaatttgatgaggtagtgataagcgaccatccgctggatcatgtggaacggatcctgcccaggaattatgagaaacagatcatcaatgaaaaatatgattacatagaggaagtaattgaggaatgcctgtttaataagaatgagaaggcggccaccacggacagggtggaccagttcatgacccatcctgtctgggggattcccatcttcctgggaatcatggcgctggtgtttttccttacatttacggtgggcgatttcctgaaggaatatttccagatggggctggatgtgatttcggaatccgtgcttgccctgctcaccaatgtgcatgcggcccagtggcttacctccctgatcctggatgggatcattgccggggtaggcggaatccttacattcctgccgaatatcttcatcctgttcctggccctggcttttctggaggacagcggctatatggccagggtggcctatgtgatgaatgagaccatgggcatggtgggattgtccggcaaggcgttcctgcccatgcttttggggttcggatgtacggttccggctgtaatggctacccgtgcactggagagtgtgaaggaccggcgcaggacaatcctcataactccgtttatgtcatgttctgccaggcttccgatttatgtactgtttgcagaaatgtttttcccggacaaagcgcttctggttgcatactccctgtatatcataggactctgcatagctatcctggtggcattcatcgcccatatgcatgagaagcacgacagtgcgcagaatgcccttctgattgaactgccggagtataaaaccccaaacagcaggacggttgccatctatgtttgggacaaggtaaaagactatctgagcaaagccgggaccaccatattcatcgcatccattgtgctgtggtttgtcctgaacctgggaccagccggatttgtatcagatgtgtcggacagctttgcggcaatcatcgggcatgtccttgtgccggtgttgagaccggccggcctggggatatggcaggtggcggtggcgcttatctcaggcctttccgccaaggaagtggtggtgtccagcttcagtgtgctctatggaatcagcaatattaactccggggcaggcatggctgaactttccgccagcatgtccatggccgggtttggcggcgtgaacgcatatgcgctcatgattttctgcctgctgtattccccgtgtatcgcagcggtagcaaccattaaaaaggaaaccggatcctggagatggacaatcggcatggtggtgttccagctggtggtcgcatggctggcagccgtggtggtgttccaggcagggagcctgctgttcgggtaggtttgcgcatcctagggtgtgtttgaaaattgctttccgtcagctgtgcgtcccactttgtgggagatttggtcccgatgagggaggcgtagcgggctacgttgaccgaattgggaccaaatataccgcgaagtggggcgtgcagatggcgggaatgaattttcaaacacaccctagtacagcattgcataagttccggtgaatatagcacccgctatttccgccagtgccgcgttgccgaaactagtcgtagggtccactacgccgtcgtttcggcgccttgccctgacagaaatatcaggcactctattcaccgaaacttgcgcaacgctgtactagcagatgggaatggcgctgctggatgccagggtaagggattgttcctgtcttgaatagaaatatacctgattggaaagacggtcctctttgggaacctctgtctgattgatgtgggccacaagcctgctcatctcattgcaggaaatatcgccgtcatcaggaagaagaaggacttcgtggatgctggatggaaggatgatgatatccttttccatgctgtccgcgaagtttttcagcacttcggggtaaaggatgcaggcagccccattaattccggatgtgttgctcaggacatagaaaggagcggatgcgtcggggtcaggaagcccataatccactgggttcccgttagaaggctgggaagcggattcctgttccatggcctgggaaaggtcttcgatgatccgtgccatgctggatatgacgggaggaaacagcttcggcgtgttggcaagggctgtttccttcagctctgccagggaaatgttccagatgtccaggtgtatattgtggatggtggcggtcatgagtccgctgtcatcctcatggaggcacagataaaagaccagggccaggtccatccagggaatatggggaatgtccgttaaaagcgcctggttagaatctgcatgaatcagcctgcaggcaatatggggcctgatttcctcgaagcatgcaagcctgtcatagtccacatcaggcggcgtctggttggcctggtacagggctatgagttccgacacgatatccgccatgggacgtccggcctgatgctggagatagcagggattcaggtaaatggcgggtgccacgtggccgccgtccttggcaatacacaggccatccagcatcaggccgttgttcttgggaaccctgcgcagcgtaaggtcatatccctttcctaaagcatgttccatgtgttcttttacttcattgagaaatgtttcgtattccacgaaaatacccccttggttttttatttatgataactgttatacagttccatatcatctgtaatgggattgtaaggggaggtccggaaaaaaatagacatgccgccttagaatacacaagataaaaatgaatatgagaatggaaagatagtattcaaaagaattgcattcagcttaatccatacaggggattttgtcaagagtggggagggggattttatgaattatttacatttaccttccataaatgaaattgacgaaatgacgggcggctgttatactcaaacctggagcgggatgtggcggttcagatatgtcccggagtcagatactttttgggattgcgggtaaaatcatgggaaatgaagaacatctgctggccaggaccgcgttgctggccggggaaatcatgcttgtaagcggtgctgagatagccaggattgaggatacaatccatcatatattgggctgctgtcctgacaggaaggcgcagaccatggtgttcagcacggggatatttgtgagtctggaggacagcggcggtgaggccatcaccttagtgcgccgggtgaatgagcgttccactaacctgggaaggatatatcttgtcaatgaggtatccaggaaactctgcagtcaggccatgacccctttggtagcatatgaggagctggaggaaatcagggcaagaagccagtataaaaaatggctcaaggcgctgagctatatgttcattgcatttttcttcggaatggtgttaaagggcagcatggtggactgtgttgcggctgcggtgacaggcggcgtgctgggatttgtcgtatacatggcttccagaatccgtctgaatgacttctgcaccaatgtgctgggagccttctcactgggcacggcggcgctggcgctgaaccggtggctgttcactggaagcagtacggatatagtcatcatcagcgcggtcatgcccctggtgcccggcgtgatattcaccacggcggtaagggatacgctgaatggggattactcttccggcgccgcaaggatgctggaagccattgtgacggcgctggcagtggcggcaggagtgggggccagtatggcgctgttccaccagctgacaggaggcgggaccgtatggtaggggaaatgatgatgtgtgcacagatgggaatacagaacatgggagttcaggccgtggagggacaggccttgggtgtacaggccctgggtgtacaggtcatgggaatacagggagctgggataccgggaaccgccatacaggtggccggagcattcatggcagtactcagttttggtctggtactggacctgccgcaaaagtatctggggtggtccgggattacaggaggcgtctgctggctggtgtacattcttgtgaaggcaggcagcggatccctggtattcggggcattcatgtccggcctggcagtggcgctgatgtcccatgtcctggccaggatactgagggcgccggtaaccgtaatcctgatacccggcatattgcccctggttccggggacgtccatttataactgggtatatcatattatacgcagcagccgggagcagtccatgtactatcttattgagacgatacagattgccggagccattgccatggctgtgtttctgatggattccatgttcaagatggtggggaacaggaagaaagtgtaaaaaggacttgaagtttttggagaaatatagtatcataatggagatgcgtctgtagctcagtggatagagcagtggcctccggagccgcgtgcggaggttcgattcctctcagacgcatttttgattgcgcagattatgggtgtatgggattttcatatcggatatcatttcataagatgatataaaatgccgcagtgtgccgggattcattcctgcatactgcggcatttggcatataacggctgtccgttgtcgtgggccggtccggtgggaagcgggtacatgccgtgccgttcacctgtaatgattcacagctgtgccagctggtttttataggtcagggacggggaatccatgtaggtctggatgctgcagaaataatccagggccgccttgcggcagttctcaacatggctgcgcatcaggccgattgcacgttccgtgtccttgtccagcaggcagttgaggatatccaggtgttccagacgggcgtcatggatctgtacctggttctgcttgctggaaatgatgacacgggtgttctcatcaaatatacggtgcatcatatcgatgatatagcggttgccgcagtgttcgatgatgaacagatgcatggcagtgtccaggcggaaaccgttctggatatcaggggcatccccttcgaatttgccgcagaaggccagcagctcctggcggggaagatggggcgctgccaggcgcacggcaatcggctcaatctcaattcttgtctgaaaaatctgaagcacatcgtttaaagatatatctgtgacgtaaatcccctttttaggcatgatcttcacaaatccttccatctccagacggctgatggcctcacgcacaggcgtacggctggcacccaggtcagctgccagctgtgcttcgttcaacagggtcccgggaggatagatacagttgaccagacgctcctttaatatacaatatgtgtgattttttaagtccttattggcggtttttgacataataaaatctccttgtagtatacaactgattataattataggctatgcagataaaaaaatcaataaataagtttaaaaacatactataaaatcaatgcttttataaagtatacaaaatatcttcaaaaaagtaattggatatattgcataaaaataaaagtcaaattgtgtagaaagtgtatattgaaaatgaaaaacgcatgttgtatactacagacatgactaataaatgcaacgaggtgggaacggaaagaaaaacaacaccgcgtggcagggcaacattacaaggcggggcaacaccgctggacaaagcaacatcattaaggcaaagcaacatcattaaggtaaagcaacatcattaaggcaaagcaacatcataaggcaaagcaacatcagaaaacaaagctacagtaaggagagtatgatatgaagaaaaaattattagcagcagcaatgatcgcagccatgtcagtatttatgttagccggttgttccggtgagggaggaaggcaggagcagacggccccggccaccacagccgcaccccagggaagcgatgcagcggcccagactgagaagaagagcaataagatggtgaaggatccttataaggatgacattaagcttgcatacgttgcacacgatatcgggacacctgtaaaccaggcatggctggaaggcattgagcgggagtgtgcttactatgacaatataacggtccagggctttgacgctaagagcagtgcggaagagcaggttaaaatcatgtcggaaatcattacacagaagtatgatgcaatcatccttcaggcaagcgataactcagcccttgcagcatctgtaacagaagcagaggaagcaggaatccctgtcatcaccatcaatatggacgtggattcagtccattcagcccttgtacagatggtggactacgacgcaggccgtctggcggcagaagagattgcaaaggaactggacgggacaggcaagattgtaatcatccagggccttcccggaatcatccgtacagataacctggaaaaaggattccgtgatacaatcggccagtattcaggcattgagatcatcggttcccaggcagccaactttgagaaggaaacagccatgagtgtgatgaacagcttcatgcaggccaatgacaagattgacggtgtatttgcaatcaacgatgccatggcagagggcgctgcccttgcagctgagtcagccaaccgtctggatggaatggtaatctggggcgctgacggtgagaaggacgctcttgcaatgattgaaagcggacagctgacaggcaccatttataccaactgctgggatgaaggttccactgctgccaaggtcgcgcttctcatgattggttcggaatacagctatgacgtgctgtccaagaccccggtcatcaacatggagccggttgtggtcactaaagatacggtagtccagatccttccggaggaccgctggtaatagaaacattggaaaaggaaatggcggcaggagcggcattggcagctcctgcccttgggaatttcatgataccaggcttgtggaaagaccttgccccatatcgtgaagtgctttcgcacagggcgcccaaaagcgggacgctgagtactcaatgcaaggagttaatttatgaagcagaatacaatcagacgttttatttccctggccatgctgtttgtgctggtgattttattttctgccaccagtgactatttcctgcaggcaaagaatatcatctccattttcagggatgcatctgtcatcgggattatcgggattggggttacatatgtgatcatcacaggcggaatcgagctttccacgggttctgccctggcccttgtgggaatggtcatggctaatatttaccgttataccacgcttcctatatggcttatgctggccgcgggcatacttgtgggtctggtggctggctggttcaatggttttatcataaccaggttcagccttcccgaattcatagccaccctgtccaccttaagtatatacagggcacttacctatgtgattgccattaaggaaaatgggattattaccagccagcccatgaaggattacaggtttaccgtgtttggcgggtctgtgggcggtatttattatgtgaccattgcatttttcgtgctggctgtcatcgggcagctcatccttaaaaagaccaggttcggcacgaacctctatgcagtgggttccaataaaaaggcggcggagctgtccggcatccacacggacaggaccaggatggctgcatttgtcattgtcggtttctgcgtggcagtcggctccattttcaccacatccaggcttcagagcaccacggctgttctgggtaccggcctggaattcaatgtgattgcggcggttgtggtaggcggctgcgccttggacgggggcaggggcgatgtcataggaaccgtcatcggcgccctgttcatgtcagtgctggacaacggcatctacaaataccagattaacactgcatatcagcccattatcaagggcgtcatcatcatccttgtggttgtgtttgacgcatggtataacaagcggatggagcaggcatccaagaacaggaaacggctttgcgaggaggtgacggcctcatgacaggaggaactatttcaggcgggaacatttccgaagagaacatttccgaagagaacatatccggagggagcatttccagcgggaacatttccgaagagaacatatccggcgggagcatttccggagggaacattccagaggggaacatttccagggaaacaatccttcaggcgctggatatcgataagagctttggcggtgtgccggttttaaagcatgtgaacctggacatcaaaaaaggcgaggtccatgcccttatgggagagaatggggcgggcaaatccaccttgattaagatcataacaggggcgtattccaaggacagcggacagcttaaatggaaggggaataatgtggaaatcaacagcaggagcgactgccaggcactgggcatttcctgcgtgtatcaggagctttccgtcataccggcccttaccgttgcacagaacgtgcttattggcaaggagccaaggattgggaagacgcatctgattgaccataagaaaatgaacgcaatggtccaggaactgattgaccgttatgagtttccgctcaatccaatggattccgtcaatgacctgggaatcggacagcggcagctggtggagatattaaagggactgtcctcggacgcagacctgcttatcatggatgaacccacggcgtccttaagcggccgtgaggcggaaatcctgttttccatcatagaagccctgagggataagggcgtcagcatcatctacatttcccacaggctggaggaggtttaccgtctggctgaccgtcttaccatactgcgggatggggaaaatgtggtggtcctggagaaagaggaaatcaatccggtggaagtcatccgtctgatgatcggcaaggtggtggatgagtcggaaggctcggtcaagacctttcggaaaaccggcggcgaggctgcattggaagtcagggatttaagcagcaggggagtatttgacaaagtgagctttcaggtccgcaggggagagatacttggttttggcggcctgattggagcgggcaggacagaattggtccgctgtctttacggcatagatggatacagcagcggtgagatttatctggaaggggagaaatatgtccccagggtgaagaagagcattaagagagggtttggattcgtgcctgaggacagaaggaaccagggattcatcccgcttctgtccattaacaggaacacggccctgaccaactatgacctgatccgcaaaagcggcggggccatatcaaagaaggaagagcttcagatgtgcctgaacgccattgaggcggtggatatccgtcccaaggacccggacaaggcagtgggactgttatcaggaggcaaccagcagaaggttgtgctgggcaaatggctgatgcgggacctgaagcttctgattgtagatgagccgaccgccggaatcgacgtgggggccaaggacgaaatctaccatatcctccgggaactggctgacaggggtgtgatggtcatccttgtatcctccgaccttcaggagcttctgcgggtttcggacaggatacttgtcatgcgcaaaggcaggatagtaaaagaatttgcagagggaacggtaacccaggctgatatactggccgcggcatccgggcttctgggttaaggagggatggatcatgaaacgggaagtcagtttaaagagatacagtaagatattcatccttctgggattcatgctggtgctgaccatcatcgcgccccacagtttccccaccattgccaacctgtccaatgtgctgtggtccgtatccgtaatcggcatcatggtatccggctccatctttgctatcctggtaggcgggatcgatctttccgtgggctccatgctggccctgacaggaatcatcgtggtgaggatcatccggtttttcgattattcggtcacaggcgtccttttaggaatcctggccgcccttttgtgcggcgtgcttgtgggcgtggtgcacggcatcatcataacaaaattcaaggtgcctgcattcctcattacctttgcgacccagagcatcatatccgggatttccatgatacttaccaataataaaatcctgggatgcctggaaccgaaggcatttacctatatcgggatcggcaagctgtttggactgcccgtgcctgtcttcatcatggcggcggttgcccttataagcttctatgtccttgataagacccagctgggccgctatgtctatgcggtgggaggcaacccggaggcatccaggctgtccggcatttccgataacggcatcaccatgatggcctatatcttttccggcctgacagctgccatcggcggcattgtccttgcctccatgacccagcaggccatggccagcacgggcagcggatatgagacagaggtaatcaccgcggcggtcatcggcggcgtcagtctggccggcggcgaaggcacggtgatgggagccatattcggcgctgtcctggtagggcttctgaataatgggatgaacctgatgaatgtgccgtccacccaccacggcctggtaaaaggcctggtaatcatcgttgcggtggcagtggacatcatgggacatcaggaaaagaaaaaaggtttattcgcatcattattccgcaaacaaggaggagctgttcaatgaaaaaaatagattcacacctgcatatagcaaaaatcatagcaggatactgccgcagaggggaactacgggctgcgggaaacggcatggcccagtggggcaacggcgagattttccgcctgctgcccgaaggctatggggataccagctttaccgcggaagccgcccttgcaatcatggaccatcatgaggtggaaaaggcggtcctgatgcagggaagcatgtatgggttccagaaccagtaccactatgaaatcatgaaaaagtacccggaccgtttctgcccgtcctgcaccgtggatcccttcatgaccaattacctggatatcctgtcctttcagttaaaagaacagggattccgcctggtcaaattcgaggtaagctccggaggcgggctcatgggctgtcacgacccctttgacctggattccggccgcatgatgaagatatatgaaatgatagaccagtgcaatgccgtggtggcccttgatataggggacctgacgatggccagttaccagccggagaaactggcccgtgtggcaaaggcatttccaaacatgaaaatggtcctgtgccacctccttgcccccaccagaggggaagaggaccgtctctggtccgacctggagctgttaaaccaggataatgtatggtttgacatctcctccgtgcccaaaatctatgccccggatacatatccgtatcctgatgtgaacaccctgctccaccaggccgcatcccgccttggcatccgaaaactcctgtgggggaccgatgcaccctttgcagccacccaggacagctacggtcatctgaccgattacctgacctatggcggctggacggaagacgagctgaatgccctttactataacaatgccgcttacgtatatttccggcagaaggaggcatgaaaatggtcagagcaaaggaatccgtaatacagacaaccaaaccggccccatttaacgggacaggtgaaatctgtgtcagggacctgttaaacggaccggatgaaatgtatggcaaaggaagggttttcgcccacaccacggtctatcccggttcagccatcggttaccacgtccacaccaacgaatcagagacttactacatactggagggcaccgccagattcaatgacaacggaaccgaacgcatcctccatcccggcgacgtagcctttaccggaagcggggaaggccactcaattgaagccatggaaggccctgtggagatgattgcccttattttatacaaaaaggaaccatccgaataaaaatttttttaaactgaaaaagcccttttactgaaaagctgccgtatgcaaccggaaatccgcatataacagctttttattttaccccaaagcccatgccgctgcgccctgtatcccgggaaccggcgtgccggacctgattgccgatgttcttatcccattgcattttcccacgctttttgttagaataagacgaagtggttatgatacccaaatgatgcatatagaagcatgaggactggaggacttatatatgagacagaacagaagacggacacgcggcagaaggtctgacgctgacaagataaaatacatccggatggcggcaatcccccttgcggtggtgattgtgctggtgattatcataatggtcatggataaaaagccaggtgacaaggagacggcggccacgcccggaacaggggtatccgctgagtccggcccatccggcggggatatcagtatttccggcgacgggactgaagcgcaggacgcaggtgtggaaccggacaacagccagtataccacggatttttcccattatgagcttcagaaggacgcggttccccaggttaacctgctgatcagcgagtatttccaggccaagattgaccaggatgcggaaaagttatttgaacttttcggcaaggccgcggatgagagcctggaggcgcgcagggaagagctgaaaagcgaggctgtctacatcgaggattatcaggacattgtatgctataccaagccggggctgacagcggattcctatgtggcctatgtgacctatgaggtgaagttcaggagggtggataccctggcgccgggacttatgtggtgctatgtgctgaaggatgacaatggcaattacatcatccgcgaaaatgtagtgggggatgaagccgattacgtggcaaagcagaaccagtctgaggatgttcgccttttatccaagcaggtcaatgagcgcctgcgccaggccattgaatcggataccctgcttgcggggatttacggcgatttgaggaacggggcagtggtaagcagctcagaggaggacggccaggacagcatggtatcccttgaggatgacggggccgggacttcgggagccggtgaaagcgctgcagcggggaacagtacggatgcaggggatggcgccggccaggacggtaatgccgcagctccttcagacgcggcatccggccaggacggggcggacgccggcagcggggaaagccagatacctggcgccggccaggcagatgcatcacaaggacaggatacggccccggagacaacaggtggttctgaggtaaagattgaataaagctggaggaagacaggacatggatgtaaaggatttttattttgatttaccggaggaactgattgcccaggacccgcttaaggaccgctcgtcctcacggctgctggtactggacaaggatacaggggaagtgcagcacagggtattccgggatattgtggagtatttaaggccgggggactgtctggtgattaacgatacaaaggtaataccggccaggctttttggcgtcaagaaggatacgggggccaagattgaggtcctgcttcttaagcgcagggaaaatgatatatgggaaacgctggtccgcccgggcaagaagtgcaggccggggaccgtcatagagtttggggaaggcctgctgagcggcaccgtggtggagacggtggacgacggcaaccgtctgatccggttcagctacaagggcatattcgaggagattttagaccagctgggccagatgccccttcctccttatatcacacatgagctgaaggacaagaaccgctaccagaccgtgtatgcaaagcatgaaggctccgcggcagcccccacggccggactgcattttaccaatgagcttttaaaacagattgaggatatgggggtcaggattgcgcatgtgacgcttcatgtggggcttggcaccttccgtccggtgaaggtggaaaatgtcctggaccaccacatgcattccgagttctacgtggtggaagagtccgaggccaaaaaggtaaacgacacaaaggcggccggagggcgggtcatctgtgtggggaccaccagctgccgcaccgttgagtctgcttccacggacgacggtatcctgcaggctaaaacaggatggaccgagatattcatctatccaggataccggtttaaggtgctggacgccctcataaccaatttccaccttccggagtccacgctggtcatgctggtaagcgcgcttgcgggaagggagcatatcctggatgcgtataaggaagccgtgaaggagcgctaccgtttcttctcatttggggacgccatgttcattgcatcccacccagcggcccaaaagcggtgaatggaccatggatatggatggcgcagggaagacggcatggatgtaaacggtaaaatggatttaaacagtaaaacggatgtggaaaataaagaggaaaaaagagaggaacgtctcaataaatggctgagccagatgggagtatgttccagacgtgaggcagaccgcctgattgaggccgggaaggtgtgggtggacggcagtccggctgccatgggccagaaggtgaagccggggcagaaggtggtatgcgacggtgtcccggtcaatgggggcagcggcgcggacagccggaagccgaagccggtgcttcttgttgtgaataagccaaggggaattgtctgtaccacttcggataaggaccgggcaatgaatatcgtggaatatctggattatccggagcgcatctatccggtgggaaggctggataaggattcagagggccttctgcttatgacaaaccagggggacctggtgaataaaatcatgcgcagtggcaatgctcatgaaaaggagtatattgtcacggtggaccgtccgctgacagacgatgccatggacaggatggcaaaggggatttatctcagggaactggaaacagtgacacggccctgtaaggtgaaacgggtggatgggaaaacattttccatcatcctgacccaggggctgaaccgtcagatacgccgtatgtgcgaagcctgctgctgccatgtggagcgccttgtgcgggtgcgcatcatgaatatacggctggacggcctggagacaggggcgtcaagggaagtgggccaggaggaataccgggagcttataaggcttttaagggactccagcagcctgccgggagggcgcgggcgcgccgttccccataaggccaggacagtaaaagattgatcaggagaacagaatggaagacaggattcagagaatgaaagagttggtttccaccctgagacaggcaggaaaggcttattatcaggaaagccgggaaatcatgagcaattttgaatatgacaggctttacgatgaactttgttccctggaaaaagagacaggaatcatcatgtcaggaagccccacccagagggtgggatacgaggtgttaagcgagctgcccaaggagacccatgagtcccccatgctttcccttgacaagacaaagagcgtggaggaccttcagtcgtggctgggggatcagaagggacttctgtcctggaaaatggatgggctgaccattgtgcttacctatgaaggcggcaggcttacaaaggcggttacaaggggaaatggggagattggcgaggtcatcacccccaatgcccgggtgtttgccaacgtacctcttaatatttcctacgagggacagctgatcctcaggggagaggcagtcattacctattcggattttaagaggattaacgaagaaatcgaggacgtggacgccaagtataagaatccgcgtaatctctgcagcggttcggtgcgccagctgaacagccagataacggctgagaggaacgtgcattttgaggcatttgccctggtaagggctgatggcgtggattttgggaattccaggaagcgccagtttgaatggctgagggagcagggctttgaagtggtacactacgaagaagtgacggcggaaagcctgcctgaggcggtcaatggatttgcagaggcagtggagggcaatgacgtgccttccgacgggctggtgctcacctttgacgatatcgcatacggggaagccctgggaaggacagccaagttcccccgcaactccattgcatttaagtggcaggatgaaatcagggagacaaggctggattacattgagtggagcgcgtcaaggaccggcctgatcaacccggttgccgtgtttgacccggtggagctggagggcaccacggtgagcagggccagtgtccataacctgagtatcatggaagcactggacctgggccagggcgataccattacggtgtacaaggccaacatgatcatcccccagattgcggataacctgacgcgcagcggggtcagggatataccaaaagaatgtcctgtgtgcggcggcgagacccagataaagcagatgaatgatgtgaaaagcctgtactgcaccaacccggactgtcaggctaagaagataaaaagcttcaccctgttcgtgagccgtgatgcccttaatattgacgggctgtccgaagccaccctggagaagttcataggcgcgggctttatccatgagtatgcggatattttccatctggaggagcataaggatgcaattgtggagatggaaggctttggacagaaatcctatgacaacctgattgcatccattaagaccgcaagcaatacaaccctgccaaggatggtgtatggtctgggaatcgcgggaatcggccttgccaatgccaagatgctctgcagggagtttaaatctgattttgagaaaatgcgccatgcccaagcagacgagctggttgccgtggatggaatcggcggcgtcctggcccaggcatggatggattattttgcatctgagaagaataacctggcagtggaccatctgttaaaggagcttaccattgaggcggagcaggtggagacaatggatgccatatttgaaggcatgacatttgtgattaccggttccgtggagcattttgcaaaccgcaaggagctgcaggaggttatcgagagcaggggcggcaaggccaccggctccgtcactgccaagacaacgtatctgattaataatgacgtggcctccaattcatcaaagaataaaaaagcaaaggacctgggggtcccaatcatatcagaagaggagttcctgcgaatgttgtagcacagtttccgccggcaggccctgggggatgtctggatgccgctatccggaacgtttaaaggctgccggtgaagctgtgctgattgtgcataaaccacacaacacacaacatttgaagggagagaatgatatgccgattaaagtacaaaaagaacttccagccaggaccatcctggagtcagagaatatattcatcatggacgaggaccgggccatgcgccaggatatcaggcctttggagatattaatcctgaacctgatgccgttaaaagaggaaacggagacccagcttctgcgcgccctttccaacacgccccttcaggtggactgcacctttctcatgctgtccacccatgtgtccaagaacacctcggccagccatctgaataagttttacataacctatgacgatatacggaagaaaaagttcgacggcatgattatcacaggcgcgccggtggagaacctggagttcgaagaggtgaattactggcccgagctttcaaaaatcatggagtggagcaagacccatgtgacctccaccatacatatctgctggggagcccaggccggcctgtactatcattatggaatccggaaatatcccatagagaagaaactgtctggcatctacaaccacaaagtgctggacaggaaggtgccgctggtgcgcagcctcaatgattatttcctggcgccccattccagatatacggaagtgcgcaaaagcgatatcttaaagcacccggagctgatgatactggcagaatcagaggaggccggcgtattcctggtgatgagccgcgacggcagccaggtctttgtacaggggcacccggagtatgacaggatgaccctgaacaacgaataccacagggatctgaataagggcctgaatcctgaagtgccctgtaattactatgagcataatgacccgttctcagtaccggccctgacctggaggaatacatccaatacgctgtatacgaattggctgaactattatgtgtatcagaccacgccttatgtgctggatgaggaagaggaagaaactttgtaatatagatatctgaataggtccatgagtatgcagccggagtgcatattcacgggcctttttatttcctgtaaaccctgaaaatccattgtataataatcatcaggaactgtttatctatgggtaaattacctgaaaagccggccggttaaaataaggtcaatatggaagtgagaaatttgcatgatttggatgtttgcatcttaaattagtaacctgtaatcaaataaatattcccctccctgaggtacacctcatggtaattcgtcctgctaacgggtaaaattcccatataattgtcgaaatgtaggaggacatctttatgaatgagaataagcttgtgtttcaggattttcttagaagccaaattcattcgtatcgtagcgttcatgctttttcccaagaacatatggcagaagccctgcgtatctcgccaaggtcctatattgaccaggagcatgggcgatatggcttttcagcaatgacgttggtatactatattttcctgctgaatgatgaagaaatccttactttcatcagggaactgaggtatctgatggggaggaggaaagaagatgttgcataaagccatatttgattctgcacaaatacataagttgttgacactacttggggcagacctgcattatatcggtttccggtatacggaatacgcccttttgttaatggaagaagatgagcagtgtatccactccgtcacaaaatgtctgtatcctgaaatcgccagacgctatcagacttcatgccacgcagtggaacggaatataaggacgctgtcgcaggtggcctggaaatccgaaccaggactccttcagaaaatggcgggccatacacttgagaaaagaccaacatcaagccaatttcttgcaatcctttttgcatgtcttactaatatggatcctgcttctcacgaataacccttcatattaaaaatcagcgacttatgtaaaaaatatccggagccgggagtaaaaaacggttccggatattcttatgtcatggaaccggcgctgtacaagaccaggcatataagcattccgggccatttgacagaaaatatattaataagattgtaagtattgttaaattgaatagatgcaataaatttattataataaatgtatgtatctggaaataatttatatttacgcagagaggggattgttatgaacaaacgaaaagcgttatgtctgctgatggctgctgcgatgacggtcagtaccgcgtttactgcatatgcagccgacacaaaaattgataaggtaaggctggagttttcgtatggcgaggcgcctaaaagcggagatgacataggcgacattactgtaagggcaaaagacagtgaatactatgtggagtctgcggagtataccaactcggatgatcaggacacatggacggttggcgatgtgccggaggtgaagattgagctttctgcaaaggacggttaccgtttttcctatacaagcaagagccattttacactgagcgggtgcaatgctacgtttaaaagggcaaaagtctatgacagcgggtcctacatagagatatatgcggaactgaaacgtattggcggcaagctggaaggtacgtccaaccttgaatgggaggataccgtggctgtgtgggacgagattgagggggccaaaagctatgatgtgaagctgctccgtgacgaaaagacagtgacaaccgtcagcaccaccgggacatcttatgattttgcaggctattttaaccgggaaggcgattataccttccgcgtaagggctattgcaacctacaacagcaagacaggggaatggtcagatgattccgacacactgtccattgacgaggatgagattgccaattacggcggcagtggacactgggtccaggatggcaatggctggtggtattcctatgatacaggcggttatccttcctcatgctggaagcagattaacggtgcatggtaccatttcaacagttccgggtacatgcagacaggctggctgagactggacggccaatggttctatctggcagacagcggggccatgctgaccggatggcaggccattaacggaaagtggtattatcttggcacagatggcgtgatgtatgaggatacatggacacctgacggattctatgtgaatggttccggcgtttgggtgcagtaataataatgacagtccaaaaaaatccatataaatcaagggttctgccgattgtgatttagtcctgctactttattggttaattgagatagccaaagaaagagaggacggcgccgttaccatctggatactgtctattatcaagtgaataaccaaatccgtaccgggagtctgtccaggtatggtttaacaagaggaaaaggactagatctagcaaaatttatttgttaggtttagtcctttttacattttaggaagaggagggtagcgctgtcttaaatgtcctgaaaaaggttgttctttgtatgagaagaccaatgattgttgtttctttatcatcatggacacaaagggcatgtccggcaaagggctgtcctacatagagttctccttcactgatggtgatacggttgtcatacttataactgatagaatcatattcaccttgataggtgaagttgaaataaaaaagtcatgccgatggaaaagttcctggcgtcctccgctttgatggacacagattaggatttcttcatctggcggacctggccggcaaaacattttttctgattggcttccaactggaaaattgtgatatgtccaatctaatgtcaaaaattgttcccgaagctgtatgatggacgcgcacaatatgacaggataagggatggggcggggaggcacggaaggggggagcattgctgctatttgaacgtatggtaaagttgccgccaaggatattcataccgtagaggctgcaacaaattttggatttgctaccagggaatgtgaacttataggtaaccacatatataccaaaatggtatatatgtggtacaaaaggttggctgatcaactgattattagtattttgactgataaaaagcccctaatcggtttctgctccgacattcagctttttgacggattctcgttgaacaagctgtgtcccaatccggattttaatggaacgcccgattacgcttcctttgtgccgctcaatcaacgacaggagacagtccacggcctcggttccgaatgaatgccgcggaacgttgatggttgtaagacgaggggcagatatttggcaggcagggcggtcattgaaaccgatgatggatatgtcttccggtacccgtatccccttttctgataacgcacgcatgacaccgatggccatggtatcatcgtctgcgacaaaggcagtgggcagggatggggatgtctggaggtatatcttaaaatcctggtaacttccttcttctgtatatctgactttatagtgatattctggatgtaactggatgcccagacattccatggcatctttgtaacagtgttccctttctccaaaactactgatatgaacctgactttgcagatatcctatgtgtctatgtcccatctgatacagataattgacagcttggtaagctcccatggcgttattaatggataccgcatttatattttggtttgtaaagtcattatccattgaaatatagggctgttttagtttcttaaaacaggcaatatcatcatccagcatttctgttgcaaaaataatgaatcctttggcattcatttggtttagattatctatctgttcatctatcggatttttcctgtctacagtggtcaagagaatatgataaccatgtttacgggcatggttttcgatgctttctgtcatgagcagaaagaatgggtgctggtccaggatcagtccatgccgccggtatatgacaaagcatatgttatcattttgacatggtggatttggatacggctttattaaattagaataccccagttggcctaattgctgaactatgcgctcgcgtgtggccgaagagactcccggcttgtggtttaatataagtgataaagaggctggtgatatatttaattggtgggcgagttctctgtttgtcataatgactcctgtttgatgtattgaaatagatgatttcctgttaacattattataaaatggtttataaataaagtcaatgatatttaataaatggtttatgcctagtgcttgtggttagatttgtgaaatatgataacaacgttaagaaaatgacaaatgtagggggagttattgtgcaacatgtatgaaaaagcaataaataattatgaaatatatcaatttacaaaacaaaaatctaccaatataattaaatcattcaataaacggtttataaaattacaaggaggaaacataatgattcaatatgaaaaagccacaggggaatttaagctaaatggaaaaaccgcaattgtcacaggtggtgccggaggtattggagaagcgacagctagaatgtatgcagcaaaaggcgccgatttggttctggttgatattaaggatacggtaagtgacgtggcttccgctattgctaaggaatacaataccagagctattggaatccggtgtgacctgacgaaagaaggggacattgagcaggtggtgaccaaggctgtggatacctttggcgaaattaatattctggcgaatgtagcgggacgtgtggatttggataatgcggaggatattgattttacattggtagagaatcagatgaatgtgaatgcattcagcgtattccgcctgacccagaaggttggaagggtaatgatacagcagaaaaaaggcggaaagattgtttgcgtaacatcacaggctgactttattgcaattgataagcatgtaggatataccatgagcaaggcggctctggtagggatgataaaggtactggcgcttgaatgggctgaattcggcattaatgttaatggggtggcgcccacggtagttcgtacttatatgggggaccgcgcatggcagggaaaagtaaaggacgatatgattgaggcgattccagcccaccgttttgcagaggtggatgagatagcggcagctatcctgtttttatcatgcagcgagtcaaatatgattaccggagaggatttggtagttgatggcggctttacaatccgatgaatggggaggatgtttatggagtgcctgcagaaaaaagcgtatgaaatccgtagggacgtaattgaaatggtacataattcatctgctggtcatgtcggaggtgatttaagtgtggtggacatcctgacagtactgtatttcaaggttatgaatgtgtctccagagaagcagcattgtactgacagggaccgcttcatactgagcaaggggcactgtgcagatgctttgtactgtgtcttgggagagaaaggcttttttgataaagatgaagcaataagattattcagtacttacggatccagatatattggccaccccaatattgagattccgggaatagagattaattccggttctttggggcatgggatatcggctggtgtgggaatggctctggcagctaaaatggatggaaagacatatcgtacctatgtggttgtgggagatggggaaatggcggaaggctctaattatgaagggatgatggcagccggccattataagctggacaatctatgtgtaacaatcgacctgaaccggctccagatcagcggcgctacatcagaagtgatgtgcagtgatagtttatcggagaagttcaaagcctttggattccatgtgattgatgtttgggatggaaatgactgcggacagctggtgaaggcttatgatgaggcggctgcatataaggggaggcccacggcggtcatagcccataccgtgaaaggaaagggtatttcctttatggagaatgaagcctcctggcaccatggcgtaatgagtgaggaacagtattccagagcggtaaaagagttggaagaggtgatggcatgaacaaaataacaaacagacaggccatctgtgatacattgatggaagcggcaaagacggataaggatattgttgtcctatgctccgattcaagaggctcagcgtcaatgacccctttttttgaacaatatcccggtcagtgtgtggaggttggcatcgcagagcagaatcttgtcaccattgcagcggggctggcctcctgtggaaagaaagcatttgcagtgtcaccagccagttttatttctaccagaagctatgaacaggcaaaggttgatgtggcttactcagggaccgatgttacccttgtgggaatcagcggagggattagctatggggctttaggcatgacccaccattcctgccaggatatagcggcattttctgcattgccggggatgagggtatatttaccaagcgaccgctttcagacatcagagcttgtgaaagcattattgcaggaccggaaaccggcatatataagggtgagccgctctgcaacggaggatatttatgacagctcaatggaatttgagatagataaggcaaatgttctgaaagaaggggaggatgtactgattgttgcgtgcggggatatggttccgaatgcactgtgtgctgccagccagcttgaagaacaggggattcgcgcaggagtgattgatatgtactgccttaaaccttttgacaaagatacgtttttaaagtatgcacatacgacccgcctggtggttactgttgaggaacattccccctatggcgggcttggaagtattacggcaatggttttggcggaatgttgtccaatgcgcatgctccggattgcattgccagatggccatatcatagcaggaacaaatcaggaagtatttgtacattatggaatggatggggcagggattgcaaaacggattcaatcggcattgacagaggggtaggggtatgaaatatgttttagggatagaccaaagtacgcaggggaccaaagccattctgtttgatgaaaatggccgtctggtggaacggattgattgcaggcataaacaatggattgacgagaacggctgggtatcacatgatatggatgaaatatatggaaatgtgatacacgctgtacgggaagtggtcctgaggacgggcatacagaaaggcgatatagctgctgtgggaatcagtaaccaaagggaaaccacggctgcatggcacagggatgggacacctataggcatggcggttgtatggcagtgttccagggggaaagagattacggatgaactgacagaatatgcccgggaaattaaggccaggacgggacttccgctgtcgccgtactttccggcagctaagatggcatggcttatacggcatgtcattaaagaaggcgggtacttaatggggacaatggatagctggctggtatatcggttgacaggcggacggtcattcaagacagattattctaatgcttccaggacacagctttttaatcttcataatctgagatgggatgaagacatctgcagcatatttggggttcctgtggaggtactgccggaagttgttgatagcaattctgtgtttggatatacggattttgagggctttctcgacagccctgttccaatacactgcgttcttggcgattcccacggggcgctgtttggacagggatgccatggaaccgggatgattaaaactacgtatggcacagggtcctctattatgatgaatatcggaaaggaatttaaagccagtacatgcggtctggccacctcacttgcatggtccattgatggggaagtggcgtatgtattggaaggaaatatcaattataccggtgccgtaattacttggcttcaggatgatttgaaaatgattgtctcaattaaggagatagaggaggcgatagagaaagcgggggatgcggacaccacggtacttgtacctgcgttctcaggactgtccgctccatattggaatgaccgtgcaaaggcggttttatatggtatgacaaggacaaccggaaggaatgaaataatcaaagcggcagttgagagcattgcgttccaaattaatgatgtgttggatgccatggagaaagatagcggtattataatccgggaactgcgtgcggatggaggggcaaccaggaataagtatcttatgcagtttcaaagtgatattggaagcattgatgtgagtatccctgcccaggaggaactgtctgcgattggtgtggcatatcttgcaggcatcagtcaggggatttaccaaaaagaagatgtttttgcggaaaggatgcggatgcattaccgccccagtatgtcagcggcagacagggaaaagaaatacactttgtggagggaagctattggtttggtttcatctgtgtagaaaggcgctggctttcataaagccataccggccctgccttatgtgggccggtatcataccaatgagcggacggatgcgcgtgttacaagctccgtgccaatccggtatttataagaggggatggcatcacactctccgcggtcatgctcgatgcggctgaccaggaggtcgatggccatagcgctgaaagaatatctgggaacgcgtatggaagataggggaggggaagacacggagcatacgggacggtcattatatcctataagggatacatctcctggtactgatatgcccgcttcaaacatggctttcatggcaccggcagcaattgtgtcatcatctgtaaaaaaggcggtaggcaactccctgcccgtgctgatgatgtgtttgaaatcccggtagcttccctcctctgagtaatcgagacggaatatgtagtctgaatttagctttaacccaaattgtttcaacgcattggaaaatcctgtctcacgttcgccaaaactgttgatatagatacagctttggagataaccgattttggtgtggcccatggaaacaagatgttcaacagcctgaaatgtgcctaacgtattattgatggccactgaatcaaggtttttaaaggggaagtcattatccaggatgacatatggaaaattcaattcagagaatacactgatatcatcttctaacatctctgttgcaaaaatgacggcccccctgcagtccatggaatttaacatacgcatctgaggtttcaatggattgcgtttatcaatggaattaaacaggatgttgtaaccatatttgtgggcacagctttcgatgctttccattattaaaagaaaaaaaggtgaggagtctaaaatcccgccatggcgtttataaacgacaaaacatatattgtcactggcgggaggggatatttctttttttatcaaatctgaataacccagctgatgtagtttttccagtacatttgcccgggttgaagtggagataccaggtttgttgttgatgattagcgaaagtgtggcaggagaaatgtccaatagctttgcaatttcacggttagtcataagtccacctcgtgtcgatacatttttcttctatccattataaatctaaacatgttgaatgtctatgtgatttatataaaatgttgatgataaaaagatttcatttaacagattaaaaaacgaattgaacgtttataaaagaaaatgagtaaaacatagtagaaatggtaatctatttttgagttaatgtgagtattatacaaaaataataaactaggttcgtataaatgttataattcacaaaggaaatgtttagatatataatctaaatataaataaaaatttataaacggagggggaggatttagaaaaataatattatttaatggaaactaacaaataataatttattaaaattgggggatttatacatgaaaagaagaattgcattattacttgcagtaagtatggcgtttagtacatttacaataggatgtgcctcacaggaaacacctataactgaaaatagtgttggagatacaggaactgagagtgtttctgaaagcgatgttgcatctcctgctgaagaagaaacattggtggatcaactggtgcgtgaatgctctggtctgtcagggatggatgcctatgacttttttaccaccctgtcagatagggggttatcccaaggagagattattgacttttttgtcaaacttcctgtctcccaggcaaataaggaagtctatgatttatatataaacgatgcgctggatgtttatgcggagagcgcaccggaaggaaccgtatacggaaactatagttgggcccttggggatggcactgaaatcacagggccgtattcagggaataccaatttaaagatggcatatacggattacatgcctgtggatgagggaccaattggagatcctgataagaattataaggttggggttgttgctatcagcgcaattgattcatggatgggaaacctttatgattccatacagtatgaagcggacaggcatgaaaacctggaacttgtatggatggattacggccttgattctgacggctgttcggacgccattgacatgttgattgcacagaatgtggatgcaatattattatggccaaggactgaggcggcaactgcagcaccggcccaaaaggcggtggaggcaggtatacctgtaattacggttgacaggttgtgcggatatccggagattgatggtgtgatcagcggaaactttcctgccaatggtgcgcagtgcggtgcataccttgtgtggaaactggcacaggaatcaggtggcgggtccgttgctggaaatatcgtactgttgagaaaggcagccggggttacggcagataccctgagatgcggctatttcctgaaggttatttcatatttcccggatatacatattcttgagtcttattatgacaatgatgatacggagcagtcactgataaatgcgcagaatgcgttacagctgttcgatgatattgatgcattcttctgtgagggccttacccagacaccggtggcaattgaggcagttaacagtgccggccgctgggagagccgggaagacggtaagaaaatcattatgcttacgattgatgatacgaaggagtccttcaatttccttgaccagggtatggtggaggtcaattgcccgtatacaccacttattggcgatatcggtatccgctatatcataaagatgcttgaaggggaggctcttccaaaggatattgcgattcctaatatcccaatggttacgccggagggagaggtggtattcgggcttaagacaatgactacgaaggactggtaccagtatgcgtcaggccctgactatgtagcgaaatagccgatgctttgctgtaattaaaaggagaggatttctgccgtgataagaaaagaaggacaacttagaaagacgatacaaaatttaacagagaaaacccagggacttttcatctccatattaattctggcggtgctgttaatcatagctgcctgttttatacccagggtataccagttaaaaaaccttgagaacttgttgaggacatatgcccctggcggaattgccgcagtgggcctgagccttgtgattttgacaggggagattgatgtttcggtgggggctatcatgactctctccatggcggttgcagcaaagatatatgatttgaatgaaccggcggccattgcagcaatatgcggtactggtattgctgccggcttcctgaatggatatctgattaccaggaccagggtcccgtctttgatgcttaccataggaacaacgtctgtatttaacggactggctgctatattggtcagggcacagaaaaagtacattacagatttatatcaaataacgctttcccttgcaaaaggaagcatattcggaattcccatccccttgctggtctgtgtgatattagctcttgcattcgagtttgtactaagaaaaagtgcatttggcaaacagatttattataccggggccaataaacgtgcttcctggatgagtggggtggacattgggaaggtaaagattatctgttttactgcaagtggtctttgcgcagccatagcggcccttcttatggcaggacagctgggaagttccacggtacaattgggcaacggatatgaggtgactgccatatccatcgccgttctgggggggatttccctcaacggaggaaaaggtacggttatcggaaccttgctgggttttataactatgagcctgatgcagaatatgcttgcgattgcaggactaggaacttatgtttcaaccacgcttaaaggagtcatgattatactggtggtatacctgtatggtttgacggtccgcagacgggcatgagccacggtctgcaggaaggttgtttatggaattcttagaagggatagcttatgaagacgttggataatagtaggttgggaaaaatattaagccgtcatatgctctggtgtgctattgtaactgccttgataggagggcggatattaagcccttacttttttaaggggaataatatcactgttattctatatacttgcgctatatatggtctgctggcaattgcggaatcattggtcctgctggtggcagagattgaccttactataggcatcagcgctgttgtatcacctgcattggccatttacctggccaatgccatttacaaggtatgtctgggaacacaggtggtacgtggaggttatgttacggcgccatggtggatgattgtcgtgtttactctgctgatatccagcctgattggtttggtcaatgctgttctggtagttaaatgcaatgtgcctgcttttgttgcaactattggaatgcaatatgctgttacgggcattggatatatcataacaaaagggactcccttgtttatgacaaaagtgaaggggtccggtgtcattggcggaagtaagataggaggcattgttccgctctgcctgtttttgttccttcttattgcaggtatctttatatttctgtgcgcatctacccgctttggcatgcggatatactcgacagggggaagtgtcagggctgccacactgtgtgggattaataccggacgttggaagatgttcatgtttgtcataagcggattcctggcaggcgttacgggtgtggtatttacatctaagctgcaatccattgatgtgacccagaccacagggtatgagatgaccgcattggcaattgcaatcattggaggtattgagctaaatggcggtgttggtaatctgaaaaatacagttaaagcagcattatttatggcggttctttccaatgtaatgagtatgataggtttcctgtcttaccatcagacatttgttctgggactctttattgtgttgtttgcgattctgcataagagaagtgacagcaggcgccttaaggaactgaatattgttgaggtgtagtaggaggaaggtgaggtgagacgatggatggcgggatgattggaaaaaaactgttgtcaatgcaggatataaaaaagggctttaacggagtacctgtattaaaaggtattaattttgaagtggattatggagagaatgtagcaattattggctccaatggagccggtaagtctacgttgatgaacattttggcaggggtccatcatgcggacggaggagaaatttattttgaggggaaaaaggttgacatccatgacccgaatgtggctgagcgcctgaggattggcatggtacatcaggaaccatccctttgtgaaaacatgaaggtgtacgagaatatattcctgaacagggaattaagaacatcttatggaatgctggaccggaacaggatgagggctgaaagccgtaaggtaatggaaagtctgggctttgagattgaggtggaaaagaaggttcaggatattaatcttgtaagcaaggtgatagtatccattgcaaaggctatgcttatggaaccgaagctccttatactggatgaggttactgccgccttgaaccaaaaggaagtagagcatttgtttgaaattatctgtggtctgagggagaaaggactgggaatcatatttatcagccataaaatccgtgaaattgtgcagatctgtgaccgggtggtggtgcttcgggatgggttggaagctggggtatttgacaaaaagacagatattttgaatgaaaaggatattatcaacctgatgttgggagagaaggagtggaagggggaatatttccagagggaaatgtctgaccatggacacgaggtgcttttgagcctgagagggttgtccaggcatggaatgtaccaggatatttcgatggatatacatgagaatgagattgttggtcttgcaggactgaaaggttccggcataaccgagttaatgtattcaatgtttggcatcatgcaatatgacgaaggaagactggagatgaaaggagaagttttgagggcggcctgtcctcaagatgcaattaaacggggcgtatgcatgataaccaatgaccggcagcgggaagggcttgcaatggggcttggaattgaaactaatgtattgattgcagctctggataaggtacggggaaagaatggactccttgataggcgtatctcggaaaagacggccagggagtatatagaaatgcttcaggtaaagactaccgggccgtcccaacaggtccagttcctgtcaggcggaaaccagcaaaaggttgttgttgcgaaatggctgctgcgggattccagggttatcctgattgatgaacctacccgtgggattgatatcaaggccaagaatgagatatataatcttcttataaaggaaaaatcaaaaaataagggtattgtcatctattctccggaaacacgtgaactgctgaatgtctgcaaccggattattattatcaacagagggaaaatcattgccgaagtgtcccggtcggatcctgattttacagagaaaggtattttggagatcatgcactcctattaaaacaagaacaataaaaccaaaggaggtttgttatgcctgagatttatgactgcaaccatcatcctgtccgtcatatgcgcgccagggtgaaccatatccgcatgcattatgtaattgctggggagggagaaccgcttcttctgattcatggaacaccaaagacccatttctactggtataagcttatcccgcttcttactgaccgctatacggtaattgctcctgatttaagggggttcggggatacggataaaccgccggcagaggatgggtatgattccatgacgaatgccagagatctgtctgagctgatggaacagctgggatatgacagatattatgtgcatggggaggaccggggggcggagtttgcctatgtgctggccgctgtcaatccggataatgtgaaggccttgtctttctgcgagatgctgttatctggtgaggatttagataccatgtcttattttacgaaggataacgtaaaccgtcagtttaatcagaatgggacatggcagtggcatattccatttttctggatacctcatgtacccgagatgctgattgccggacatgaggaagaattctggagctattggatgaaagcggaaacatggaaccctaatgctatttcggatgagtgtatcaaggagtggatatcccatatcaaagcgccgggcggattgcggggggtgctggagacataccgggccgcgtttaagaatgcagaaataaatgcggagttgaaaaaacagaaaatcaaaatgccggtcatgacaattggtgctccggaattttttggaaatacagtagaaaagcaaatgaaagaatttgcttctaatgtggtatcaggacaggtgtttgaggagtgcgggcatagcctggcgctggaagcgccagagcgattggcagaggctttgaaggcgtttttcaaataagatacctgattgcattaaattgaaaagttaagtggagtatacggggcctgttttgtatagtataaatacggaacaggtccctttttatacgctgttttgcgtgatatcaatcccatggccggtttatcacacccaaaaaagatattatatgccaggggggagaaaaagggttgacattttcatgaaagataactaaaataaatttatatattaaataaaatttatacaactaagggtggatatatggctataaaagcaaaagaactggctcagaagcttggcatatcagaagcaacactttcccttgtccttaatcataagggagggataagcaaaaggacaagggacatggtgacggagaaggttatttccatggggtatgggtacatgtttaaaaatgaccagaacccggttgcggatgataccgcgggcatatctgaggcaatcccgctgccggctgagaatgggtatcttgggtttgttatttatcaggatacaggattgtttatggaaaatacgccgtttttcccattgattattgatgggatggatttgatggcccgaaagtatggataccggcttcttgtggttaacatcagaagggacatggatttaaatacgaaactgggctatataaaagacagcggatgcgtgggttatgtcatatatgcgccggaattcccggaggaagaggtggattacctgaaacaattaaagataccatttgtccttctggataattattttcccgggaaggatattgacgccgtcacgctgaataatgagcagggaatctatagtatattgaagatgcttatagataaggggcatagaaggatcgggtatttgagcagcggggttaatatacagagtttcagggagcggagggacagttacaggcggcttgtgcctgaaatggggcttgtcctggaacccaggttcttctgggagattggatacccggaccagcaggcggcacagggcatggaccggatgcttggacggaatgaaggacttcccacggcctttataacggataatgactatgttgcattcggggcaatgaagtctttgatggaacacggttattcgataccggcggatatctcggttgtgggatattcagacaggcccgtgtgtatgtatattgtgcccaacataacaacggttaggattccccggatgcgttttggcggcgaggccgtggatctgcttataaataaaatcctgaaccggccatatgatgaggagaagagtacggtgaaaacagcagtatccctggaactggttgtacgggatagtgtcggtgatgtccccaaatgatatattgcagtatgaaagcctgaggctatatggtctcaggcttttattttgtaaattttattttgtaaaaatgtgaaagctgcacaaatgatacaggataaaatagaagaaacatacaaaaatactagctttattagaaaatatattgacttttgcagcataaacagctaaaatgaatttataaatttacaaatttataaattatatcaatgaggaaggggtattttatgaagaaaacacgtttattagcattaacactatcagcaatcatggttttggggacaaccgcctgtggcggggggaatgcggatggcagctcatcgaataaagaaagcggagcgcagaccacaacaaagctaacaggggacacgcttgaattaaaagcaggccatgtgctgactgaggactcgccgtaccatctggcgcttacccaatgggcggatgaggtgtacgaaaagacagagggcagggttaaggttgacgtatttgccaattcagtgcttggaaatgaaagggatatgatagaggcattacagatggggacgcttgatatcacacttcccaattcggcgcccttaagtaattttacggatgcattgaaggtatttgaccttccgtttctttttatggaaccggaggatgcttacgcggtaattgacagcgaggttggggccggcatgctggattccttaagcgatatcggtgtggtcgggctttctatgtgggaaaatggatttcggaatatagcgaataataaaggagaaatcaggaccccggatgatttaaaggggcttaagatcaggaccatggaaaatccaatccatatggcatcctttaaagcgtggggggcagatgctacggcaatggcctggggtgaggtttacacagcattgcagcagaagaccattgatggactggagaatcctttcacaccgatttatcagaataaattacatgaggttgcgccctttgttacagtgacagggcatttctattgtccggcgccccttcttatttccaaaacaacatgggaaaaaatatcgccggaagatcaggcggttatccgggaactcagcgacaagtataaggaagtcgaaagacagatgtgcatggaagtggatgaggattacaagaacaggatgatggaagagggcgtgactgttgtggaggatattgacaaggctgcatggagggaagctgcacagccggtctatgatgaatacgcagatgaaataggggtggatcttttaaatcagatacaggaaatgatttcaaaatgaggtgatgatgaatgaaacggctggaccggtatttagatttatatgaaacagcttcctttgttgtactgttgtcggtaatgacgattgtcgtgttcatacaggtaatatgcagatatatcctgaaggcttccctgccctggagtgaggaagtgtcgcgttactgtatgatttataccgtatttattggagttggggcagggctcaaggcaggtacccatacaggggtagacgcattggtcatggtgtttcctccttccattaaatggtgggtaatcctgattgaaaaggttctgtgctttgcactgtccgttatcttttttgccctttcggcggaggttgtcatacgactgttccaaagcgggcaaaagtcggctaccctgttcatacctattgcatttgcatacgttgccatgccattgggtttcctgggagggagcatacgaagtttccagaacatcatcatacatataaaggaggggagaagatagatggctgcaatactgtttatatctcttataatcctgattgcaattggtatgccgctggcatatgcgctggggggagcatcatttttcgctattgcatcatcagaccttccaagtatactgacggtacagcgtttttttaccggtgttgattcctttacattgatggcaatccctttctttatgataagcggttcgctgatgagcaaaggcggggtatcggaccgtctcataaaactatgcagtgttttcctgagaaagctcccgggcggtctggccattgttacagtggttgcctgtacgttttttggcgccatcagcggctcggctcccgctacagccgcagcgattggcggcatcatgattcctgcgatgctggctaataaatatgcgccggatttttcaatgtcaaccgtggcaagcgccggttatctgggggtcatcatacctcctagcatcaccatggtcacgtatggcgtggcagcaggggcgtccattggggacatgttcatggccggtgtatttccaggcattctcctttgtctggggatgagtatcttcgcataccttgtggggcgcaaaaataattatgtgatgcaggatgaaagggatatgtcatccagggaaatactcaaaatagtaattgacgcaatacccgccctgctgatgccggtcatcatccttggaggcatttacggagggattttcactcccacggaagctggctgtgtatcggttgtatatggattatttgtaggctttttcgtttataaagagctgaagctgggggatattcctgagatattcaggtcctccgcgttaagcgcatccatgattctcctgataatagggtgcgcctctgcatttggtaatatcataacacgggaaatgatcccaaataaagtggcgagcctgattatagggatatctgacaacaagatcgtgttccttatacttgttaacgtgctactgctcatagttggctgtttcatggagacgaacacggcaatcatgattattgcgcctatcctgcttccggtagcaaaaacattggggattgatgtgatccatttcgggatcatcatggtcattaaccttgcaatcggcctgcttaccccgcctttaggcatgaacctttatgtggcgacggggataaccggtaagaaggtatcggatatcctgggaaagtacctgtttggatacatagcaatttctattataatactgttgattatcacatatgttcctgccatcagtacgttcctgccacagctggtggccggcagatgataagcaggaagggaaaggaaggggcatgaaatgcttgttttaaaaaatgtaaatatattcgacggcatcaatgaggagctgatgaaggatgccgcaattgtaatcgaaggggatacgattaaggatatcatcccgggatgtgagtgtccgtttgacaatgaaaaagtagtggatttgggaggaagggttgtttcccccggattcattgattgtcatgtacatttcatgttggaggaaataccggataaagagcgccagatgaacgaccagtcggcgggaggcgtgctatttaagaatgcggactcctatgtggccttccgtgcggtggaaaacgcgcggaaaaccttggaagcaggctttaccacggtgattgacggcggtggtgtcaactatgtggatgtggccctgaaggatgcaatccacctggggtatgttgaagggccggattattacataagcgggaagcagattactgcgtggacttcccacttccgagggctggggcaggagacatatgggccttgggggatgaggcgtatggtcagggagcagctctattatggtgtggaccagattaagatagagaatagcgccccgatacgttccgttggacggagtctgtctaaaagtgcatttacgtttgaggaaatgcaggccgcagttgacgaagcccattcagcagggctgatggtaagcgtacacgcaaggggggccatgccgatagaggtggcggttgaagcgggtgcggatctcatatgccatggcactggaatcagtgagaaggggctggagatggtccttgagaggggactgtatatacttccaaccctggcatctccgaatccggaaccggaaccccacatcctcaatgcaaaaagcagccgggtgattgaactgctcagacagaccggggaaatccagtgggacagtatcagaaaggcatataaggccggcgcaaggattgcgctgtcaacggacgcaggcggagtgggcattaaacatggagagaacgcaaaggaaatgctccgcatgaaagaaatagggatgtcgaatctggaatgtcttagggcggccacgtcagaagcagcgaaagccatgcgcctgaaccatgttggaaggattggaaaagggatgaaggcggatattgccattctgaaggataatccggtagagaacctggaaacagtgtgtgatgtagcgggagtcatcaagaatggggcaatggtctattataaggagatgtaaatcatataggaaagggccgtctctccgggcggcccttgcaatatttatttctggagtccataccatatatcggcggagctttttatgcattcatctatcctgtcataggccttggcggtaatgatctgatagatatcctgatgcgccttaaggacatactcccctttttgatgtttgtgggtattggatatggaagcacggatggagtccattatgaagccataaatcttgtttgccatcggattatggcacgcattgccgagaagccggtggaattcaatatcattttccaggatgcggtcggaagaggccttgttatcaatcagatactgaagctggaccaggtttttctccaacgctgcccgctcctccatgttttcatcataatgttttaggactaattccagaatgtccacctcaaatacacgccggaattcatacaggctgtccatgtccggatttgtgatgaaaaatgtaaaaaggagggagtcgatcagtttgtttcccggtgcctcacatacataggtgccgttcccaaccttgatgtccacgagaccaaaggcggataagattttcatggcttcccgcactgaaccccggctgacgccaagtccttcggcaatttccagctcattgggaagcctgtcccctgggagcaggcggcggtcgattaacagctgtttaatattattgatgacaatatccacagcagattcccttttgtttgtcgtaaataaatcattcatagaggagaacctcctttgtttttaattttattatagcagttcataggttaaacgtcaaatgattaatgttttttcgattaagtattgacattgggcggaagatgtgttatacataaaacataagatgtttgatgatttatgtataacattaattatcaaataatagcacaatgtagtttcatttcataatccagatgggaggagtcatatgaacacagaggaattaagacagatggcacagcacttgagacttgtagcggtcgacatggtttacaaaggaaaggatggacatccaggacccgcattatccattgcagatattgttacaacgctgttttttgataagatggatatccggccggaggattctgagtgggaggatagggaccggtttatcctgtctaaaggccacgcgtgtccgatttattacgcggcgctggcggaaaaaggatattttggcggcagggtggaggattttaaactgaggtctttgggaagcaggtttcaggggcatccggtcatgaacaagacaagcggggtggatatgacatccggctccctggggaacggtcttgccatagcaagtggcatggcaattgcagggaagtataatggtaaggattacaatgtctacgtgattacaggggacggggaattacaggaaggcgtgtgctgggaaggaatcaacatagcggcagcccataagctggataatatgattgcctttgtagaccggaatggctggcagagcggaggatctgttgaggacgtgattggctccaataatataaaggaccggtttgaggcgttccaatgggatgtacaggagatagatggccatgatattgacgccattcgggaagcggtggataaggcaaaagcagtaaaaggaaaaccacatgtaatcatctgcgattgtgtgaaagggaaaggcgtttcatatatggagaatgataatgcatggcataaaggtgttccaaccgatgaacagtatgctttggcagttaaagaattaggaggtgtaatataatggcagatttcagagggacaagagaagcattcgcccaggcactgattgacatgtcggaaaccaacgataaaatcatgtttgtggcaccggattcattgaaggccatgcgtgccacaaagtttgcagagctgcatccggcacaatatgtggaggttggtatcgcggaacagagtgctgtggatgcagctgcaggtatggctgcatgcgggctgattccttatgtgggtacctatgccggattcctgaccatgagggcctgtgagcagatgcggacatttgtggcctacccggatctgaacgtcaaatttgtgggaatcaatgcaggtctgttgggcggggagcgggaaggtgtgacacaccagttttatgaagatatagggatcctgtctaatattccaaactttaccatttttacaccggcagacgcatcacagacatatcatgccgtgaaggctgctgcggaaattaaaggtcctgtatacataagggcgggaagcggaagggaaaaggacgtttatgagaaggatgtaccattttcaatggacgggatccgtatactgaaaagatatgggacggatacactgctgctatccagtggttttgtgcttgaccgggcattgagggcggcagatttattgaaggaaaaggggatagacatcactgtcggggacatcaatattatcaatgcaaagaatccggacaaggtgataacggaaatccggaaggctaagcggattgtcacggtggaggaccataacatacatgggggactgggggcttacatcagtaagttggttgtggagaatgaccctaagcgggtatccagaatcggattgtcttcctttggggagtcaggacctgccgatgagctggcggattactatgggtttgctcctgaaaatattgcagcagttgtagaacagggaatggaatgactgatatggccgggataccggtatcataaaaaataaaaagtgaggtaagggattatgtctaagatagtggtaagtgtaattggcgcaggcggaaagatgggtacaaggaccagcaacaatctggtgattaaatcaggagactttgaggtccttatggtggaggcttctgaagccgggattaagagcatcagggagcgaggattcatacctgtttcagtggaggaagcgctgcagaggtcggacgtggtcgtatttgcggtgccggataccctgattaagaagttatcggctgtctatgttccgcagttaaggccaggaaccgggtttattatcctggatcccgctgcagctgttgccagggaattgacgctgcgggatgattgtacgtttgcggtagcgcatccctgtcatccgtcctatttcttggaccaggatacatatgaagcacgccaggaccgtttcggaggatgcggcgggaagcaggacattgtaatgtcaaaaatccagggagatgacggacgttttgcacagtgtgttgaggtggcaaaacagatgtatgcgcctgttgagcatgcgtatgtcatgacatcggaacagatagcattcctggaacccacgctggtagaacttcttggggccacctgtctttatgcaatggcagagactgtggatgaggcagagagaagagggattgacagggaagcagccgtttcctttttaactggccatatctataacctgtcagctaatttcctggggtatattccaggcaagccacccgtgtctgatgcatgtaaggtagccataggacttggcaaccggctggtcatgcgtgaaaactggaaagagatatggaaggacgatgtccttgataaggtaattgcaaccatgctgcaccctgataatccacagatctgatgttaggaaggagctgttcgatatgaaaatagttgttttagatggctataccttaaatccgggtgatctggactggagcgggttagaagccttgggccagtgtactgtgtatgaccgcaccccgcttaccgatgtggaggagataatcaggcggattggtgacgcggagattgtgtatacgaataaaacaccgttgtctgcggaggtattcgatgcatgtccgggaatccgtttcataggggtcctggcaaccggatataatgtggtggatatacaggcggcaaaagcaaagggaatccccgtgtgcaatatcccatcctatggaacggcagcagtaggacagtttgccatcgggcttctgctggaaatctgccatcacatcgggcatcatgaccaggccgtgaaggaagggcgctggagcagcaatccggactggtgtttctgggattatccgttgattgaactggacggtaaaaccatgggaatcatcggatatggccgtattggccaggctacaggcaggattgcccaggccatgggcatgcatgtgcttgcttatgacacataccatgatgaggaactggttaacggacagtgcagatatgtggatgacctggatgagctgtttaaagaatcagatgtgattgcccttcattgcccgctgttcaaggaaacggagggggtgattaacaaggacaatattgccaagatgaaggatggggtcatcattcttaataattccagggggccgctgattgtagaggatgacctgagggaagccctggacagtggaaaggtgggcgctgcgggactcgacgtggtctctacggaacccatacgcccggacaatcctctgctgggagcaaaaaactgtattattacaccacatatatcatgggcgtcaaaggaatcccgtcagcggttaatggatttggcggttaagaatctggaagcctttatggatgggaatgtggttaaccgcgtgaattaaaaaaacgctgcggcttttaacgcagaaaattaatgatccgacaagttaaagaggctgtttgccagtgagtgaaaaactcccccgcttttcacaacgggggagttttccttgaaagtgcttaaagtaagacctgtcctaaccagcagctatttggttcatccgtttatatctttcacactatcccgtacaatcagttccccatttatctcaacccttgtaaatgatgtttcctggttctgtaactgttgtatcagctgaaacacggcttcagatccaaagcgctcctgaggcacccggatggtggttaactttggctccaccaaggaactgattggacggtccgcattgcctacaaatgaaaagtcatcaggcagttgataaccaaattccttcatgccctgcattgccccgattgccacaaggtcattgtccactaaaaaggcggtgggcagttcggactttttatgttttttcagaacgggcaggattccttctgccgcctggtcaattggatagccgatggtataggtgaacttttccatatccattatgccgaaggatgccaaagccctttttgaaaaattgcggcgttcaatgaaactgttaatcggaaggccgctggaaagataacctattctgcggtgtcccatatcaatcagatactttgcggcaagatagcacccttgctcattattgacctttaccgtattaatcatccgtccattatagtagttgtctaagaggacaaacggaagtcccaggttttcgaaataatcgatttcattatcctgcatttccgtagcaaatataacataaccgacgcaattggcatccgttatataatgaatctgctgttcgatatcagcccgttccaggttgatgattacaaggttataaccgtatttccttgcggtgctttccacaccgtccagaattaatggataaaaagagtttaacccaagcatcttcccatcatttttataaataacaaatccaatggtattttgaatctgtggctcgttgtggggattcttcaccaaatagccataaccaagattattcatttcctttattatcttttctcgtgtcttatcgctgattccaggttttccgttcatgactaaagatagtgtagccgcggatacccctaactgctgtgccagttcttttgccttaatggccatcatttctgcccctttatgatttttctgtctttatatgacattttagagcagtttagatataaagtcaacgtttcgaatggtatattcgagggaaaatgagtttcacagatgataattcataaataatttacaaaattagaataataaaaggtatctcatattgcatcaaacagcgatattttgtaaataatttataaaataataaactataaaggcaaaaaagcattggaaatatagtgaaagtgatgataatacaaaaataaagcaggatgatattgacaaaaacagcattttcgcctatactatcaaatataaataatttataaataatttacagaaaagaggcgatggatagatattttcataaagaaataaaatgtttataaagagcacatagaaaagcgtattacaatgcgaggattttgcagattaaatgtttagaaatgttaattaggaaagaacagaggtgtatacagatggatatatcgaaaacccggtacataatttttgatacattcgggacagtggttgactggcatggctcaatcgtaacacatggcatggctttaagcaaaaagtacaacctggatattgattgggacgaatttgccaatgcctggagaaatgacggatactttaaggcaacatttgacattgcccatggaaaacgggaatgggtcccggcggatactgtttttatggagtatctggattccagggccagggagtgcgggcttgatgtcctgtcggcagaggactatgaaaatctgggaaaaatatggcaccggctttccccatggccggatgtgctggaaggattaaacagattgaaaacaggatacgcgattggacctttttctaacggggattttaatttgatgattgatattgaaaaagcggcctgcctgccatgggattttattacgacaggggatttatttaagaaattcaagcccaatccagaagtttatgttgatgaaatcaaccttctgggcgcaaggccggaagaggttgccatggtcgcggcccatccctttgatctggacggggcaaagctggcgggctgtatgaccatatttgtaccaagaccaatggaatatgggccaaaggtaatttacgatgaaccggatggaaaacaggaagtggattatgtgttaaatgattttgttgaattagcccggctgtttggggtctgaaaacaagaggaggaggaaagatatgtttaaaatttgggctgtagtggagattatcagttggattcttgtagtaggggtaacaaagggcctgtattcaaacaatcatttaaacgaagagggaggggagtaagatgaaggctacatttataatactgtttgtcatatatctgattgcaatgggggttctcggcctgaaggggtctaagaagaccacggatatgaaatcttttgcagtgtcatcaggggatgtaaacccatatattgttgccataacatgggcggccacattcatgagcgcgggtacgttccttggcctgcccggtcttgcctataaaaatggcgtgtccctgttatggtatcatatgggacattggtttcctgccatcttaatgcttgcaatcgttgcggggagctaccggaagcttgcggataagacaaatgcccttaccatgccggactggcttgctgatgtatatcaaagcaaggggctccgtctgctgattggtattgtatgtctgtgcaatatcgtacccctggctgcccagtttgtaggcgtcggtaccctgatgaatgcaaccttggggattccttatgaaacaggtgtgttgattggtgtggtggttgttatgatctacctgttccttggcggtacatatgcgcatatctataccaatgtggttcagggcaccctgatgtgtatcgtatccatcacggtggtcattacaggattcttcctgtttgggaatgtattcacagaggttcccagactgctgagccaggcagatcccaacctgtcagctgcgtttaatccgtccgatgctgcatttgcaggcccggtggctatttcaggcatattcatttccaatgcatgctggtcgctgaatcctcagctgatgaataaggtccagtatcttaagacaaaccgggatttaaggaaattcatactatttgcaggtttctgcctgttcatcggcggcatggtggttgtagggggaatgtattccaggcttctgacaccggaggtgctggcgaatgcagatgatgcccttccgacttttgtaaccatggtatatcatcccgtggttggggcatttttcaatgttgtgctgctggcggccaccatgtcgaccacagacgggattatggtaatgatggcaactgttcttggaaacacgctgtatcgccagacgtatatacagcataaaattgactgcggacagaaagtcgatattgagaaggcagacaggatttccctgtccattgcaaaatggtccgtggtacttgttggtattgcatcgcttccgattgcgtttaacaggcccagttcattgaatgtgcttaactggattggtacgggggtcattttaagcggcgttgcaggtcccctgcttgtggcggtgacacagaaaaaggtgcacaggatgtcagccatcatagcggctgtatgcggaatcgcagcatatctggtggtttatgtgggtaaaatcatactcagcgtttatctggctgttggcgtcggctgtatcgtcagcctggcagctgcatttatcgtaaatgcgctgatgacaaagcatgatgccgggcatgcggtggtcctgcgtgtttagcatgtcagtcagccggtattgggagatacggataacaatccggcattttggaaaggagaattcttaggaggcatgatggaacggataacagatacgtatattctgaataatggatatcatataccatgccttggattcggaacgtggcagtccccaaacggagagactgccaccgcggcggtcaggacggcagtcagggccggctacaggcatattgataccgctgccgcatacaaaaacgaatcaagcattggtgaggcgcttaagctcgcagacataccgcgtgctgaattatttataaccagcaaggtgtgggatgacagcagaggatatgaaaagacaatgaaatcatttcaaaaaacattggatgatttgcagacagattatctggacctgtatctaatccattggccggctacaaaataccgctgtccggattgggaagcggttaatgttgatacgtggcgggccatgacagaactctacaagaaaggatatataaaatccattggtgtatctaatttccttccggagcacctggcggcattgatgcaaacagaaataatcccgatggtggaccagattgaatatcatccgggtcaaatgcaggaggagacagtggattactgcaggaaacatgatatcctggtggaggcatggagcccgttggggacgggacgcatgctgacagatcagaggcttcaggatatcgcttcaaaatacgggaagtcggttgcccaactgtgcatacgctggtgccttcaaaatggtgtgctgccattgcctaagtcggtgacgccatcgcgtattgtggagaatgcggatatatttgattttcatctttcggatgaagatatggcaacgattaattccatgccatattttggcgggtctgggttacaccctaataccagatgaggaggatgaagctgggcagttcggatcttgacattccggtaatggcaattggcttaatgcatctaaataagctcaacctgtatcaggcagaggaatacatatcgacatgtcttgaaatgggtttgattttttttgagaatgctgatatttacggaatggatggagggcccttcggatattgtgaggaattttttgcaaaagcagcacatatgacgccatctgtcagggaaaaaatgattctgcagactaaatgtggatttaccgaaatccagccgggacaggggaagccggaaacgattgacctttctaaggattatattttaaaagaggccaatgacagtctgaaacgattgaaaacagattatattgatgtgtatatgctccatgcgccggatgccctggcagatccggcagagatagcggaggctttggacgaactgtatgtcagcggaaaaatcagatatatcggtgtttcgaactttaacacgacacagcttatgcttttgcaaaagtatgtaaaacagccgattgttacaaaccaactgatgatgagtgttgtcaattcagggctgatttcacgggggatgtatgtcaatatggacgatatgtgtgcaattgacagggacggaggggttcttgattactgcagattaaatgatattacggtccaatgctggtctgtaatgcaggccggatatatgggcggctgtttccttgggcatccggattataaaccattaaatgcaaaaatagaagaggtagccggacggtacggtgtccctgctcctgcaatcgcaatcgcatggttattgcgtcatccggcgcatctgcttccgatatcaggtaccatgaatgtgaaacaccttgcggaaaatgcacagggcgcagatatcatgctgacgcgtaaggagtggtacgaaatctggaaggccgcaggaaattttatcagatagctatggatgcatggagctggctggcacggttgtgccagccttttgtattaaaaattgtatgcggatacaggtgacatgaaaaataaaacggcgggataggcagccgataggggtttcatgactccgtgtacacatattcccgaggtgacacaccgtagtattccctgaaggctttatagaaattactgttatttccataccctaccataagggcaatctgattgatggacaggtttgtctcttttaaccgtatcagcgcccggtacatccgccgccttaacagcaggattatatatcttcaggagaaatacctggattagggagtccagattacagcattatgtcctatgtaggggagtaatcggaggggatagtatttgtattgtgaagtttactacagaaccatgctttggctctaggaagtcattctgcccagttatgtcgaaaatactttaaacgatattcttttggagtatatccggtatattttttgaataaagtattaaaatggctgtgtgaggagaacgcgaggtagttggcaatttcaacacaggtgtattctgaatattttaacaaattttgcgctgtttcaatacggcatttgcgcacatattcggaaagagtggtattcatctcttttttaaaaatggcggagagataggacggcgagagatttacataatccgccgtggaattcagggtaatgttttcatgtaaatgatgatggatataatcaatacaccgaaggacaggtttcgagtaaatctgttctttttttagttcggccatacgttttgtatattccgtgaacatctctgtgtggagacggaaaatctcatccacagtagtgcatttgtccatgagctgaatgtagaggtcgctgatgttgtacgcatcttctgccagcatgccgccctccaggcagaaacggcaggaaagggtcgtagaagctacaaaaaggtagcggtaatgagagagccggttgtcggaaagatgaccagtaagattacctcggaataatttaatgctcaatgggatggcctgttccaaattgccgtttttcatatattcgtactgcaacagttcctcatcataggtgtggtgatggatttgttcttctttttgcttaaaacggatatcagaaagcgctttttcaatcgacttcataggcgatgcctcctttatttactgtatcacaaggggtggaaattgacaataagaatatataataaatagtaattatatgatatttatttgagagacagaatgatataaatatttcaagaagctaagagaatgaaaggcaggtgacaaacaacggagtctgatttatagccgaggaggtggcacagcagatgtggcagaccccggaggatgtggcagatgcgattacctttgcagtgaccaggggaaaacggtcaaagatcacagaaatcagattgacccattaaccggaagaagggagcagagattatggctttaaagaaagactttttgtggggaggagcactggcagcccatcagtttgaaggcggtgttctcaatacttccaaaggattgtccgtggcagatgtgatgacggcaggcgcttacggcgttccccgcacaatcacggacggaatcgaggaaggaaagtattatccgaatcatgtgggaattgatttttatggaaattataaagaagatatcgctttatttgcagaactgggctttcggtgtttccggacctcgattgcctggtccaggatatttcctatgggagatgaggcagaacctgacgaggagggactgcagttctatgaccaggtatttgatgaattgttaaaatatgggattgagccggttattacgctctcccattttgaaatgccttatcatctggcaaaagagtacgggggcttcacgaaccgaaagaccattgatttcttctttaactttgcaaaaacctgttttaaacgttataaacacaaggtgaaatactggatgacgttcaatgaaatcaacaatcagatgaattacaaaaatgatctctttggatggacaaacagcggcgctcattttggctcttttgagaatccggagcaggccatgtaccagtgcggccactatgagttggtggcaagtgcgttggcagtcagggcaggccacgagattaatcctgaatttcagattggaaatatgattgccatggttccaatctatccctattcctgcaggccggaagatatgatgctgtccgttcatgagatgcacaaccgctggtttttctgcgatgtgcagtgccggggacattatcctgcttatgcccttaagatgtttgagcgaaagggattccagctggatatcacggatgcggataaaaaggctctggaagatgggactgtagattatataggattttcctattatatgacggatacggtagattctacggcaaaaaaagatgtttcctctgtaacagacggctccggtgcgtattctgtagggaacccttatattaaggtatcggactggggatggggcattgatccggtgggactccgctatgcgttgaatcagatgtacgaacgctatgaaaagccgctgtttattgtggaaaatggatttggcgccatcgacaaaaaagaggaagacggttcctgccacgacccttaccgcatcgattacctgaaagcccatattgcggaaatgaaaaaagcggtggaagaagacggcgtggatttaataggatataccccctggggctgtatcgactgtgtttcctttacaacaggtgagatgaagaagcgatatggatttatctatgtagaccgggacaatgaagggaatggcactttaaagcgcagcaaaaaggattcgtttgcctggtaccagaaggtaatggagacaaatggagaagttttgtgaaatcattcagaaaaagaaaggaatcggaagatatgacagaagcggaaaagttggatgcaggtttagaatatgacttttgggatgaagaggttgacgggcggaagcttcacgcactggaatggtgtcagaagctgaatgcaatcccgatgcagaataaggaagaaagatcccgggcgatccggaggctgtttggggccgtgggggagaacgccaccgtgcttcctgtgtttaattgtgacagtgggaccaatattcatgtgggtaaaaattttcttgccaattataatgttactattttggatatcgctccggttcatatcggagattacgtcatgattggtcccaatactctgattacgacggtcaatcacccgttgaatcccatgggacggcgaaaacatctggggattgcaaaaccggtcaccattggaaacgatgtatggattggcggcaatgtgacaatccttcccggggtgaaaatcggcaataacgtagtcgttgccgcaggtgcagtggtgacaaaggatgtgccggataattgtgcggtgggcggcgtacctgcaaaggtgattagggaaatcgtaaatgatgtggagtaaaaaagtggaacagccgcagatgattaatggatatattcccgcggagaaacaccataatactcccgaaacgccttgtaaaaattactgctgttgctgtaccccagcatcaaagcaatctcattgattgtaagatccgtgcctttcaaaagaattacggcacgctccattcgctgagaaagcaggatttcagagaacgatttccccaattcccggtgtagaagggtggatatgtagttgggatggtaggaaaaccgtgccgcgatatcctttaatgttaccttgtcggaatgttcacttatgtattggacaatccggtctgacaggcggtctgcagggggcctttggtttgcaaaggtatactggcgggccacctgcatcaggaacgccagtgccaggggctttaatatgtcctgtgtatcttcgcctttatgggcatactcaatcaccatcatttccagcagtgtgcggatgttgcagtcatcctcgattttgaaatgaaggtattcttcagaaaagcaatttgtggaaggatcgaggaaaaaatggaacaacccggaattagcggacaacaggggcaggaaggagcggaaaaaggtctctcgccggaataacacaccaatgatgatggtttcctgattatcatgcacacacagggcgtgtccggcaaacggctggcctgcatacaattccctttcccgtattgtaatctgatgatcgtatttgtagctgagggaatcatattctcccttataggtgtaattaaagtaaaagaaatcatggcggtgaaacaattcctgtaccccgctgcttttatggacgcagattagaatattttcctgttccggacctggccagcagtacattttttcattttggcttccgacaggaaagtcatgataggtccagtcaagactgtcgaactgctcctgcagggcttcgattgacaatgacagtatggttttttccaagcaatagcctcctttcatattagctctatgctaccatagaatattataaattaccactgcttttattaagttttagcgctgatttttcagcagattccaactatactagttggcatgcaattataaaaccaggaggttatgaaatgaaaaccaaatcatggagtgataaaaacgccatcttttacaaaaaactgttttcacttgtgctgccgattgcctttcagcaatttatgctggcggcagtcagtgcttcggatgccttgatgcttggatttgtgaatcaggactccctttccgccgtatctctggctggacagattacctttgtattcaatctttttatgggtggcctgacaatgggaacaagtattctggcagcgcagtattatgggaaaggggatatgatatccattgaaaaaatctttgcctatgttataaaagtatcttttctgatatccgcagttttctttctggcgactctttttatcccggaaaccctgatgcggatattcacaaacgagccgcagttgatatctagtggaattgtgtatcttcgtgttgttgcagcatcttatctgtttactggcatttcccagatttatctgtgcattttgaaaaacacaggctgtgccgttaaaagtatggtaattggctccactgctgtggtgattaatattttcttaaatgctgcgttgatttacgggctgctgttttttcctgaaatggggattgcgggtgcggccctggcaacgtccatttcaaaactgatagagatgggatgggcctatcttgagtccctgcgggaaaaaagagccagactgcgcataaaatattgctttacaacagaaaaaaatctggcacgggattattggaaatatacaatgccaatgcttggcgactatctggtatggggctgcggctttactacatattccgtaatcatgggccacttaggcagcgatgccgtggcagccaactccattgccaacattgtcaaaaatctgattgtaagtttttgtaccgggcttggaaacggcggcggtattattgtgggtaacgagttaggcatgggaaatttaaagcaggcaaaagaatacggaggccgtctctgcaagctcgctgttataagcggcgttttgtccggcgtgtttttggtagcgcttacccccgtcatcgtaaaggtcaccacattaagtccgcaggcgacaggatatcttaaatggatgctgattctgtgcgcctgctatatggtcggaaagtccattaacatgaccaccatagccgggatatttcccgcgggcggggactctaagtttggcctgatctgtgatgcggttaccatgtgggcctttgcagttccggccggtttcttagcggcctttgtctggaaccttccagtagtcattgtattcctgatcatcaacctggatgagattgtgaagctgccggcggccatcctccattaccggaaatatgggtggctgaaaaaccttacaagatagacaatctgggtcgttactattttcaatcaatctacaggagggaacagatgaataaaattattaccataagccgggaatttggcagcggaggccgggaactgggcagacatattgcggatacattaaagattgcctattatgatcaggaaattatcagtgagctttccaaaaggacaaatctgacagaaaactatatccgccaggttgaagaaaataaattcatcccattactgccaattacaacgggaagaaccttttcatcccagttttatcaggcaatggagccggatcagacagcatttctggaacagagcaaaatgataagggagatggcggataagacagactgcgtgattgtagggcgctgtgcggattatattctgcaggagaggagtccccttcgtctgtttgtatacgcggatacggattttaagctggcccgctgcagggaaaaggagcagtccatggaaggagagacggatgcagagatgagaaagaagatgaatgggattgacagacagcgcgcgcggtactatcaatttcatacagggcggacatggggagaaacgtctaattatgatttatgtattaacacgacttccctggatattaaaagcgtgacagcggccatagtgagactctttgactaaggaaaaggctgcagaataatattatcatttaccacatataaacataagatttggcgctgtattctaaaatctggcgcaatataataaagttcagaaacaaaatgaatagagaattaaatatgaggaggaatcacttatgaacaattttatctttaacatgccgacacgcgtactctttggggcaggacagctgaaccatctgcatgaggaaagccttccgggtaaaaaagccctgattgtcacctccaatggtcagtccacgaagaaatatggttatctgtcccgtgtgcaaaaagagttggagctggctggagtggaacacgccctgttcgatgaaatccgtccgaatcccacccggaagaatgtcatggacggcgcaaaggcggtccgggacaatggttgtgatttcgtcgtggccctgggcggcggctctgtcatggactgcagcaagtgtattgcgctgatggcagcaaatcctggcgatatctgggattatagcctgagtaaagcaggcggaaaaaagaatgcggaatttgacgccctgccaatcgtatgcatcaccacctccgccggtaccggcagcgaggtagatatcgcggctgttatctcggatgacgaactgaaggagaaaaccggaattttcttcccttccatgttccccacgatctctgtggtggatgccgacctgatgatgagcgtaccaccggcacttactgcttatcaggggatggatacgttcttccatgcttctgaaagcgtcatcaataaaaacgagcatcccatgggggagatgtttgcactcaaggcgattgaactggtggcaaaatatctgcctgctgcatataaggacggaagcaacaaggaagcacgtgagaatatggcgctggcgaattccctggccgcttactatatgctttgtacttctgcccacaccattgagcatgtcatgggaagtttccatgaaaatctggtacatggcgccggccttattatgacagcccatgcctactatgacttttttgccgaaaaaaaggccgctgaagaaccaatgataaagatggcaaaggcaatgggagtagagaaccctgcttccggaaaagactttattcaagcattggatgaactgattgccgctgttggatgcgccgatctgaaaatgagcgacgccggaatcacaagagaggaattagaactgtatccgcagaagattcacgaggtgcttggcggcgacattaccgcggacccgctgcctctgtcagacaatgattatctggaaatctacgaaaaatcctaccggtaaggagggattcacttggacgataaattaaaactggcaggacaggcatacggaaaaggctttacctgttcccaggcggtgttctgtgcttacgccagtgatatgggaatagacgaaacaacggcgtgccggattatggaaggttttggcggcggctttggcgggatgttttacatggggaatccccaaaagcattccagtgtgggatgaaggtgaaagataccgtgctgattattaaccagattcttgcggaatgcccgaaagaaaaacgaacagaacaggagatggaagcatggtaagaaaaatggtatccgcattattattgatatctatgtggaaggaaccctgtattggtcaagcactgtgctgttttccggtgacattgagtggggtggctcaccgcagagtattactctgacagctgcttacacagaagaaaataccacagaaaacagggatatgctgacaaatgtaaccgcagcctatacggtataatccgtactttaacaatgtgtgtggaaattatgaggaaaggcggtgtgataaatgagaggcaggatcactacccatcaaaaaatggaacaagctgtggtggaaagcggctttctccctttttgcaaaaatgaaatccccggattttctgtggaagaacggacaccgccggaattatggtttcccgatgatgagggcaaagaggggccatgggaatggaggtagttcaatcggcatactcccgttcaccaaaggaatccaaagaacgaattttgcgttatttaaggaacctgctcccgaaggcggatgaagaacaactgttaaggctaattggataagcctgccgagaggagtaatcttgataaaagaacacacaaacactaacgatatgacaaatgggaatccggttaagctgattttagcgtttgcaatcccattgtttgtcgggaatatttttcaacagatttataatgtggcagatacgatgattgccggatataatctgggagatgccgcgattgcggctatcggtgcaaccagttccattttttccctgcttatgaattttgcctctggcttaaacagcggctatggtattgttgtggcccgggcatttggagcaaaaaatcaggataagctgaagaagtcgattgcagcgatgatagtactggatctggtaatcactttaatgctgaccgttttttcgctattgtttttgaattccctgatgagactgctcaatataccggacagtatttttgcagatgcgtattcttacatagcaattattactgccggaatgctggcaacaattgtttataatatgctggcaggcattatgagagctgttggcaatagcaggacaccgctttattttctgatcctttcctgtgtaatcaatcttagcctggactgcttatttattattggttttggctggggtgtagagggcgcagcggcggcgactgtaatcgcggagagcctcagcgcattgttctccgcaatttatatgttccgtaaatatcgggaaattctccctggccggaagcatttccatctggacatacctctgattaaagagatggcagcaacaggctttgctatggcgcttatgctgtgtgtggtggatattggctctgttatttatcagcgggcaatcaacggccttggagaaatgctgattgtgtctcacacagcagcaagaaaaatcattggtatcatgatgatgccgctggcttccattgcgacagcatattcgacctttaccagccagaattggggtgcgggtaagaaagaacggattcggcagacactgaaaaaagtgatggctatggaagtgggctgggggctgttctcctgccttgcagtctttttacttggaggaactgcggtacggattctgacaggaacctcagacaataacgtgattgacaatgcagtgctcagcctgcggtttcattttgtatgctatcctgcgctggggatcttgcttgcgctcaggacaagtttacaggcgattggccgtaaagctgttcctgtcctatcaagttcatttgaattaattgtaaaattgattgctggaatatggctgatccctaaactgggatacttatgtgtctgcctgacagagccggttatttgggtttcctgtgcggtttttctgattgcagaatttatgatacaaaaaccgtttgacagcaataaagagaaagcggcagctacgggcaccgttaacacaaaggatattctggatgactgcattgttggaaaggtggtacaataaaaaatagaaaaaaatgacagggctggtgagcagaagatggatggacaaaaagtaaacaatccaatggtacatggggaaaataggattccaaaccggattcaggtgaggaatgcaagggtgcacaatctgaaaaatattgatgtggatattccgctgaaccagattgtggggatcgccggtgtttccggttccgggaaatcatcgctggcgctgggcgttctgtacgctgaagggtcgagacgttatcttgatgcgctttcgacctatacccgacgccgtatgacacaggcggccagggcccaggtggatgaagttctgtatataccggcagcgctggctctgcaccagcgtcccggtgtccctggcatccgcagtacctttggtacgggaacggaacttttaaacagcctgcgtctgatgtattcccggctttccagccaatgctgccccaatggacacaatctggctccttcgctggcagtggcggcggggcaggagctggtttgtcctgaatgcggtgagcggttcttcggcctttcggcagaggaactggcctttaacagtcagggggcctgccgtacctgcggcggtaccgggattgtgcgcacggtagatcaggatactctggtaccggacgaatccctgaccatcgatgagggcgcggttgcgccgtggaatacccttatgtggtcactgttccctgcccggattatgttaatgtcctaaatgcatagacagcaggtactttttcggaggcgctgcagtttggcacaggataagcaatatttcataagctgcactatctaatgatattgaaccggtcttttccatctctgctgttctcctgaatgaaagaatgccggggctgtaacctttcccgcttcccttttcagaaaaaattcaaaatactattgacaaatgtcttaatgcgtcttaaaatataacagtgttatataacggtgttataaacaggagcaattttatgggtgaacaggagaatacaacattaaatctggtacataaagcagctatgcaggagtttcttgataagggttttaagtcagcttctttacggaatattgttaaaatagcaggcgtgacaacgggtgcattttatggctattacaacagcaaagaggatttacttgaggcgctggttggtgaacagtacgattatatcatgaatagattttgcaaggcacatcaagagtttgctgatttacctccggaggaacaaccagaccatcttacagattccggcgcatgtatgcacgatatgcttgtatatgcttacgaatatctgaatgaatttaaaatcattctctgcaaatcagagggaacacgtttttcaaacctcattgatgaaatggcagaaatagaaacaaaggggacacataactatctggaaatacttaaaagactgggcaggccttcccctcctattgatgaacaactggagcatatgttgataacaggaatgtttaaaacgttttttgaactgatcatacatgaaatgccacttgaaaaagcagaatattacctaaaagaaatgattgctttttacacggccggatggatgaaaattatggggcagtaagtaaatttagatattataatggaaagtgtatgctttccatcatatttaacacattggttagctaaaactaactattaaaaatcagttaacaaagattgggatattagagggagattatttttccctcatatcataaaaattttaaaggaggttgtcatcatgactcaaaaaacagacacccgtacaaaattgctgatggaatcaccatttcagctaatgctgtctttaagtataccggctattattggtatggtggttgtcgggctatacaacttcatggacagggttttggtgggacagctcatcaatgaagttgtgatgggggcggtttccatttcctatccttttacgctgataaatactggcgtttccacattgattggggtaggctcggcatctgttctttcacgggcggttggtaaaaaaatcaagatataattgataggatcatgggaaacttgattgctttaaatctgatttttggcattatcattactgtccttggaatgatatttacacgccagcttctgacattaagtggtgcagagggagaaatccttaataccgcagaacgctacttgcgcattatttttgcaggttcccttttcgtgaattttggacagtccgctaatatgattatgcgtggcgaaggaatcttaaaaaaggcaatgctgattacgggcactggtgcggttctcaatattattcttgacccgattatgattatcattatgaaaaatcagggaaagggcgtagaaggtgcagcctatgcagcaggcacgaatttcggtgcaaagcagtatgacagggtaaaacaggtcacaaaagcatttattattggtgcgacagtgattggacttattttctatgtacccatacaactggctcctggaacaattctttcatggtttatcaaagataaggatattgtaagccagggtgtgacagatttccgtattttgttcagcacttatattctacttggttttgtacttatggtcattactttaatgcagtctctggggaaagcgtcaaaagcaagtgttttggttttaatgcggcaaatcattctttttgttccgctggcaatcattcttccacaaattggcggactgggtatagatggtgtatttctagctccggcggtaactgatttacttgttttagttctagctatcgtaatgcttgcaggggaatttcataatatatcccagttggcaaaacagaaaaagtgaatttattgaatgaacaaagactttgctcttcaatagatatgaaggaggtttttatggataaaaaaaagtctaatctatcaagattgatggggtatgccggaggacataaaattttaacgtatctttcctgggtgctgtcagttgcgagcgcactattggcacttgtaccattcgtgtatatatggcgtatcgttcatgacatactggaggtttccccggatttttcgcaggcggggaatgttacaagctacggctggcatgctgtattgtttgcggttatctcaatcgttgtatacatatccgctttgatgtgttctcatatagctgcgttccgggttgccgctaatatccgaaaggagcttatgcggcacattacagccctgccccttggaatcacagaaaagtatggaagcggaaagctgcggcgaatcgtaaacagttccagtgccgctactgaaacgtatcttgcacacaggctgcccgacaaagcgggtgcgattgctacgcccataggactgctctttttactgcttgcatttgattggcggttaggtcttttaagccttattcctgttgtgcttggttttctgatcatgatgaaaatgactggaaaagatatggagcagagaatggaacaataccaaaattcactgtctgatatgtcaaatgaagccgttgaatatgtaagaggcatacctgtagtaaaaaccttcgggcagacaatcttttcttttaaacgcttcaaagatgcgatagacaattatgaaacatgggtaatggcgtacacaaggggattgcgtttgcctatgatgttctatacaactgcaatcaatggcgtatttgcgtttctgattgctggaggtattgtctttacaaggggcggagtatcagatgatttgctgttaaaccttattttttatattgtggttacgccagttattggtacgacactcacaaaaatcatgtttatgagtgaggacgccatgattgtgagtgacgcaatgggcaggattgatgaaattctgaacgaaaagcccctgcctgatagcagagtggatcatataccgtctgataattcgattatattagagcacgtcagttacagctacaaggtgaatgactccgaaggaggcggacagggtgccctggggcatgatggtgggaaaaacgcattaaatgatgtatctctgtcaattaaaacgggacagacaatcgcattagttggcgcgtccggcggcggcaagacgacccttgcaaatatcgttacgcgattttttgatccgcaaatgggacgcattctaataggaaatgtggatatacgcgatattccgaaagaaacattgatgaataaggtgtctttcgtttttcagaatagccgcttaatcaaagcgtctatattggaaaatgtgcgtatggcaaaaccagcggcaacacgcgaggagatcgttcatgctttaaaagccgcacagtgcctggacattatcgaaaaattgccggatggcatcgatacggttgtcggcacaaacggcgtgtacctgtccggcggtgaacagcagagaattgcaattgcacgcgctattttgaaaaatgcgcctatccttattcttgatgaagcgacggcatttgccgatcccgacaatgaggtgctgatccaacaggcattatctgctctttcaaagggaaaaacggttatcatgattgcacataggctttcatcaatcacggacgcagactgtatttatgtactgcaggacggtaaaattgctgaaagcggcacgcatcgcaatctgattgagagaaacggcatcttcacacgcatgtggaaaacttattctgaagcggcggaatggaaaattgtaaaggaggtaacggcatgattcagacattgcaaaggcgctttgcactatcaaggcagggggctgttgatttgataaaagggtgtattgcctgcgttttgcaggatatttcctttatgcttcccgtcgggcttctgtatcaatttgtcattgatatgatgaacgggggcataaagggaaaccgtgttatgttctatgcggttagcgccctgatcttccttttccttatttttattgtgacttggtttcaatacaatgccacctatttagccacatatgtggaaagcggtgtaaggcgcatttccttagcagaacagctccgtaaaatcccgctgtcctttttcgggaaaaaagaccttgccgatttaacaaatgcaatcatgggtgattgtgccacactggaacaggcgttttcccactatgttcccgctttggctggttctcttatttcaacaacactgattgctatctgcctgtttacttacgattggcgtatggcacttgcagcggtttgggtcttgccgattgcatttgcaattacatttttttcagcccgtatacaaggatattttaaccgaaaatccgtagcggcgaatgttgcgcttgaaagcggtgtgcaggagtgcattgaatgcttacaggacttaaaagcaaataatgcggaagcagactatctgaacgggcttgataaaaaaattgattatgtggaaaaacgtcacattatcacggaacttggaactgccctttttgttgtttcatcaacactgatattaaagtttggaattgccactgttgcacttgcaggctctgcattgcttattcaaggtgagatagaaattccgctgttttttatgttcctgcttgttgcttcaagactgtattccccgcttgagggtgctttgcagaatcttgcggcggttatttcaaccaaaacgaacatagaccgtatgaatgaaattcttgaccagccaatccagacaggcagcgacagaacaacaaataaaggatatgacattgtgttcgaccatgtaggttttgcctacaatacaggggaaactgttttggacgatgtatcatttaccgcgaaacagggagaagtgaccgctttagttggtccgtccggcggcggcaaaaccacggtatcacgccttgccgcgagattttgggatgtaaataaaggaaaaattacagtcggcggtatggatatatcgaagatagagcctgaaacattgttatcgttgtattctatcgtgtttcaagatgttacgctgtttaataatacaatcatggagaatatcaggatagggaaaaaagatgcgactgatcaagaggtgattacggcggcaggactggcaaactgtgaagaatttgcgtccaaacttccagatggttataacagtatgattggtgaaaatggctgtgaactgtccggcggcgaaagacagcgtatatcaatcgcccgtgctttcctgaaaaattctcctgtcattttgctggacgaagctacggcaagtctcgacgtagaaaatgaaaccttaattcagtctgctttgtcaagattgataaaagataagacggtacttgttatcgcccaccgtatgcgtacggtaagcggcgcggatcaagtcgttgtgctgtctggaggtacggttgctgagcaaggtacaccacaggagttgatgaaaagaggtaagatttatccccacatggtaaaattgcaaatgattagtcatgaatgggttttcccaaagggcaaaagatccgctgtctagtcttcatctgccctatgccctatttcgttcctgtaaaaatcaattttttcatccagccggtcccgatgctcctggagctgcataatctgttcatttaatacctgcctgtgctgtaccagcatttccagccgtgcctctagcgtgggattccccccggcccgcagatgtgcgtaccgtttaatctctttaatgggcattccggtatccttgaggcgtttaataaagctgatccatgcaatgtcccgttccgaataccggcggcggttgccggaattacgttccggggcaataaggccttcctgttcataatagcgcagggtatggattcccaggcccgtgagcctggaaaattcaccgattgaatattccaaggtattcacctccacctcacctccaggtaaaatttcttgacatagagtttactctacattgtatagtcgattatatcaggataaaggaggattttcaaatggtacagaaaaaaggagcatatacggtaatcaccggcgccagttccggcatcggttatgagactgccagggcatttgccgcccgtggaaggaacctggttgtggcagcccgccgccaggataaccttgaggcactgaagaaagacattttatcgaacaatcctgagctggatgtggtggtcagagccacggatctgtccgttatggaaaacgtgtatcagttctatgaaagcctgaaggagtatccgctggatacatggattaataatgcaggctttgggaactatgacagcgtggcgcatcaggatttgagaaagattgaaagcatgctccacttaaatgtggaggcgctcacgattttgtcgtccctgtttgtgcgggattataaggacatagaggggacacagcttattaatatatcctcttgtggcgggtacacgattgtacctactgccgttacttattgtgcggcaaaattttatgtaagcacattcacggaaggtctggcaagggagttggaggaagctggggcaaagatgcgggccaaggttctggcgccggcagccacaaaaacagaatttggaaaagtggcaaacaatgtctgtgagtgtgattatgacaggctctttgggacctgccacaccagccggcagatggcagcgtttctgctggaactgtatgacagtgaccaggtggttggcgcggttgaccgggaaacctttgagtttagactgtgcggtccaagatttgactatgcgggaaattccaggcataatcagaaagctgtgaaatctcaggctgagtcatgaaaaggttatgaattgactatgagcggcttatgaattttagtttttaaaaatgccttattgacagcgtttctgcataggagtacaataagttcaattttacatgaaaaccgttgagtaagaggagtaaccatggcggagaaattacagagagcctttattggtgggagaaggcatttcaagctgcggtgaatgggcttatgagggcagcctgaatttcaagtaggcgctgacggaaactctaaccgttatgatgagagcatatgtttgtatgtgaaaaaccgagtaggtggcattgcagggtttatggcttctgttcctttggggacaggagctttttgttttttgaaaggagtgggttccatggatgtggattggcggtggtgcggataacgggcggaactaaggataaatggaaagctgacaaggaggtatcaatgaaagtatctgttattttaggacatccatatgaaggcagcttcactgaacgggaagaatggttaactcagaccaggagcatggtaaaccactacttcccgtaaagcagctttccgtctgcaggatggttcaatggaacatgaataggaagctgaggagaacacttaaacatgcaatttgtgaaaaaaatacctggcgagaataaagagagaacaaaagaattactattatctggctggaatagattaaaggaaccctccaatttaggtatagcaattttgtattcgcttccaatatcaatcatattgatgacggtcaatggaatatggctttttttactctcacctgtatttaaaagttttatctattcggacggttttatagtggaatttcaaattaatataaaaagcctggtatatattttggctgtcattctgttcctgctcatacatgagctgatacatgccctatttatcccccatgtatttcattccccatgtacctattggggatttaacggtggattcgtttttgtgtatacagaagaaataatgacaaaaaagagattcatgcttatatcgatcatgccgctgctgctgttatctttcatacttcctgcggttttatcaatttttggaatctcaaattggttcattattttcctttgtattataaatgccggtggttcatgtgttgatgttttgaatatgtttcttattgcggggcaagtcctccaaaatggaacaattgtaaataatggctattcgacttattttaagaatgcggagtgacagattgcagtacatacggccggattacctatgtctcgtcgaaaagaggcggctatcttgaatatgagcgatggttaatatttttgaaagatacttaacgcctgttcagttgtgaagaatgcagctgtctgctatcatgaaaccagcaaaggccaatacaaaaaaataaggaggcactgatatgcagttaggacaggtaatccgtaaatatcgtaaaaataaaaacatgacacaggaagagatagcgggcaggtttggagttacggcaccggcggtcaataagtgggaaaatggggcttctatgccggatattatgctgctggcgcccattgccaggcttttaggcattacgacagatattttattgtcattccgtgaggagctgacagcagaggaaataaaagcgctcgtttatgaagcaaactccatgctgaaggaaaagccttataaagaggcgtttctgtgggtaaagaagaaactggaacagtatccaaattgtgaacagctgattttgcagctggctgtaatactggatgcacaacgtatgatgcaggacccggtaaagaaaatgaaacaggcacagatttacggcaaaaccaaccggatttccgaggcatataaagcctatgaggaacttctttactcacattatcagctggcaagcggagcgcttcatggaatgtatatgctggcaatggatcagggtgagatggaccgggcgcatatgctggtaaggaagcaggaggagctggcgaggtgctttgaaatgggaaaatactgtgaggcgtcttcccggcttgatattgcaaccgcggaacaggatgcagatacagtaattgctacaatgaaagaaatgctttccagcatagggcagataggcagcttttataggtcccctctttacgggcatatggaatttaaggaaatgaggggggagttcctggctgaactgaagaataatttattaaaatgctttcgggatgaagaaagctatggatttttaaaggaggatgaaaggtggaaggaaattgttctgcagaaataaagtaacattataatggatatggcaaaaggagaaacgattatgcagtgcagcagtttagaagaagtacgttccaatattgaccgaatcgataacgaaatcataaaactgatagcagagagggggaattatgtgattcaggcttccaaatttaagaagaacgaggccagtgtcaaagcccctgatcgtgtggatgcagtcattgccaaagtccggaatatggcaaaagaatatggagcagatgccaatatggcagaagctttatatcgggaaatgatttcacgatttgtaactatggagctacaggaattttcaaatagtaatagaacataaaacccctatatccaagaggacggagtaaagcagctaagatatagtgaaaatgtttggaatgaggaagggagtattgctgtggatgaacgagggacgaaagccgtggatcagggcgttttttctggcaagataggcggaccggggaatgtgagaaaaaataaatcgtaactatgaaacttttcccctgctcctgcgtctaatgattacacgtaattaaaataatcatatggaaagaggaataaagacaatgaaaatcacaaaaagaaatgtagcagtcatgaggggcggtgattccggtatcaatcttagaaaggtgaatggttattggaaaatcaatcagatttatcagtaaatcaaagaggatgcagtaaaatgaagaaattttgttctcatactttaaatgaagaggagaggtatgtccggaaatgagagagggcttatccacaacagcatagagttcatatgcaggaaggtaggcatttcaaagtcttacttttatagtttcttttcctccaaggaagaacttgtgctttacgcccggcagtaccaacagcctaaacttctgcgctgggcccaaatgctgatggaggcgctggaaatggaggcgcaaaaaaatcccttgcggaccttgctgggcctttttgctctctgccgggatatttcatttattgatgacaatacccaaaacgtagattactctgacaatatccatctgattctggcagagccatacccggaatttaagcggtgcagatacatttaatatggtgcccaaatggtacccaacctagcagaaaagtgtggaggataaaagataatggaacgaaaatatgcatttcatccccaggagtttgcgataggggagacaaggctgttttatacaaaaatggctgggaagggctggcgtcttgtaaaacgcggcgcatttttaagcagtttcaggcgttcggagccggaatcgatacggtatgggattgttccggcagtgcctgcccaatcaggtgaaccgccttttacagaagaacagattgccgcctataaggagtctggctgggcatatgtgacaggacgcggttttatccacgtgttcagcgcaaccgggaacggcggcgcatcggaattgtacctggagccggaggcgtatgcagctgcattgaaggggctgaaaaaacaatatatggtttcgtttctgcagctgccgctgtccattgcattctttctgttattagggagtatgctgggaggctatggagggcacagccacctggcggcatctgcatacaggggctggattgagaatacagcggccgtgaccggattcatctttttattcttatggctgatgtacagggatttacgggggatatggtatcttggccgtttgtgccgcaggatgaatacggggaagctttctgattatctgcaggtaccgggctgcaaaatatcaaagttcctgaacggttccctgatgctgtttaccgctgtctttggcgtcctggcaatctgccagtgggcaggaagctataaacatgcgatgccggctgaaacggatggaccgtatcttgtactttcagatattgggataaatggggaacggacacagagttttataaaaaaccaggtcagtgaggtaaaatatggacagtcacttttaacagagcattgggatacgtttgaggtgattgatgcagacggcagggaggtctggatgcggcaggatgtctatcgtctgaaggatgcaggcatggccagccaaatggcgggacttctgatgagggatgctgtatttgccggttctccagaggactttgcttcagtagatatatccgggcttgaccaggcatgggtatcggaacggctggaatgcattgcggtcaggggtggctatgtctggttcctgacatatccggctgacagccgtgaagaactggtttccattcttcaggtgttagccggaacaatctaatccagcagacggaatgtggatttatggaaatccatgattccgtctgctttcattttggacagttccctggacagggcgctgcggtccatgttcaggtactgggccatggcattcctgtctaaagggacagtaaaggtacctccggccgatgggcaggaggcattttttaaataagccatgattttatcccgcgcacatgggcggagcagacagtccagccgttcatggagcaccaggcccttttgagccacgcttgctgtgaagttacggataagcctcttgtggcaggcacagtttctggcgcagctgttcatcaaactgtcataggaaataaacagtacagcgcttccgcgttccactgcggctgacacgggacttggatgattagggctggctgccaggatcacaccgatttcacttcccgtgtttaaaagcgtgacggtaaggacgttgccgtccaggtctgttttataagatctgccccgccctgacaaaaggataccgaaggcccggacctggctgccttcctcaataatgacagtatcatgtgcatattccacaggataggcgttcaggcacgataaaagacggccggtatcttccctggaaatgcctgcaaacagcctggttccttctaaatactcaatcattggtttcatcgcaattacgttgcctgggcaacttacctcctgacatgattgtattataattgacacatatatgcaagatgacaggagagaaaaggagagcgggaatggctattggtttcacaatgttttattacggcctgtccgccgtgctgctggcggtttcataccataaggacaggaagaagacaaagatggcagtaaaaagggcgctgcttatgatgaagggagtgctgccttattttcttgcaatcctcatgtgtacgggcgccgtccttctggtactgacaccggggacgatacacggttttcttgggacaggaacgggatttggcggaatccttctctcggctgctgcgggggcagtgaccctggtaccggtcctggcagtattcccggtggtttctgagctgcttaagaacggggcggggacagcgcagatggcggcattcatatccgccctgacaacagtgggccttgtaacgctgcctcttgagacaaaatatctgggaatccgggcagcagtcctgcggaacctgttctttttcctgttttccctgctgacagcccttatattggaggcggtattatgaagaagtcaggggcatggattatgacaatcctggtctgtctgctggttctttttctggtcctggtatttctgcctggtatgtggtacggcgtcatttcctatacgggcgcaggactctcgcagttcgtatggaacctggctcctgtgttcctctgcgtggggctgatggacgtatgggtggaaaaggatgaaatgatggggatgatagggaaccggtccggtgtgtccggcgcattcctgtcactttttatgggaatgcttacagcagtgcctgtctatgcgctgcttcccattacaggactgctgttgaagaagggcgggcgcatttccaatgtacttattttcctgtgttccagtgttagtatccgtgtaccgcttctgcttttcgaaatctcttccctgggattgcggtttgcagccagccgttttatacttaacctggcagtcgtatttgtgattgcgtattccatcgaagggctgttgccggaacaggagatgggacatatatataggaagaataagaatgaatcagggcaaggatgaatcagggcaaggatgaatcagagtaagaatgaatcagagctaaaatgaatcagaaaaaataaaaatagagcaagaatgatgaagacaggatatcgcaccaagtctataattgacggaagccatgacaaggaccacaatacagggagaaaggaggaaaccgggaatgaaccgtattgaaaaagtaacacggattattgacatcattgaatccaatctgacgcagaaactggatctggaacagattgcagataaggtccattactccaaatatcatatgcaccgggtgttttcccagacagtgggacttaccatccatgactatgtcaggcggaggcagctgacagaggccgctaaactgctggtcttctccagccagtccatcattgacatagcgctggcgtcaggatatgaaagccagcaggcatttacggatatattttcagccatgtataagattcctcccagcagataccgggaaaatgagaaattctatcctctgcagctgcggtttgagtttcagggaacatacgccatgctggagaaaaaggaaagggcacagatggatatccggttggcaacagaggcggacgtcccatgcgtgatggagctggtccgcctgattgtggatggttttccgtatctggatgagacggagtatgtccgcgaactgaaacagaagattgctgggggacaggccctggtcatgaaggacggggagactgccgtgggtatccttctgttctcccgcgaggacggaagcattgattttatgggcagccatccgctgtacaggaagaaggggattcccagggcattgctggaccggcttatgggtgagtggatgaaggacaggaaaatcagcatcaccacattccgggaaggtgacagggcagacaatgggcagcgggaagaaattaaaagcctggggtttgcagaggcggaactgctggtggaatacggatatcccacccagcgtttcacactggatggggagggcggacaaggctgattcacggcatcaccggcaggcgcaccacaaagcaggcgcctccggatggtgaatccgtaacgctgatggagccgccatgtttctgtaccagctctttggcaatgctcagtcccagtccgtaatgctgtttatcgcttctggagctgtcggcctggtaaaaacggtcaaaaatatgtttttttgcataatcatcgattccgcagccctggtctgacacggtcagacacaggcttttttttgttccgtggagcagatggttcacctgctccacggaggcggaaagtctgacggagccgttctttggggtataccgcagggcattgtctaagaggatggacaggatttgctccaggcgcttcccatccccgtttatcctgggcagggaggactccggaagctctaaaagcagcgccactcccttgtcccgataaagcggttcaaaccgttcgtacatatcaatgagaagggtatccatgtccaagggcgccatgcgtatgatccagtgtcccgcgtccgcggatgccagaagcagcatatcgcccaccagataggacatacggcagcattccttatcgatattatccatgaactgctcccggttctgcggcattgaccgggccgcggacaggctggaacgtatgacggccaggggcgccctcagttcatgggaggctgccgcgatgaattcattttgcttttgctggctttccttcagcggctttaaggattttcccaccaggatccagcttactgacataagggccacgattcccgccaggttgaggaggaggaacaggaatccctgactgtacaggctggatgaggcaggatctttataggccagcagggtcaggctctggaaccccttaccgaccggaagtacaaggacacatccaagataggaatccttgtggtttccctccaccgtatatacggggctgcgcagcagcgaggaggataccggccttagggatgggtcgatgtgctgggccagggccatttccctggcgcgtccaatcaagagatcccggtcggtgagcggggaccaggagccggaatagagcaggggaatcccgttgtcctcgatgtgtatgatgagcctgccgctgctttccagctgtgacagccaggtacagctgatggtggcgccggactgaagcctggaggtgatgttaaggacatcattctggaaggcttccagtgtttttttctccagttccctggaactgaccaccaggcttcctatgaccaccagggtcaggataaggccggttaccatggtaaaaagggcggtgagctgccggtgcagttttttaatcatggccgcctccatcctcaaggcggtagccaatcccgtgcacggtcttgatctgggcagccgtgccaacggctttgaggcgccttcttaagaaatagatatagttgtcaagattgccgtcctccacttcggagtcaggcccccatatgtaggacagtatcagcccccgggggagtacctgtccggcattgcgcatcaggtattccatgagggcggcctccctcctgcttaagctgacagtgccggaaggcccggccagttcgcggcggtccgtgtccatggttatattggaaaatgtttttgcgcggccctgttccagcctgccgggccgtctggtgactgcccggatcctggcaagcagctcgccggcagcatatggcttaaccagatagtcgtcggccccggcgtccaacccgtctatcctgtcattgacgccgtccagcgcagtggtaatgatgaccggtgtggtgatatccatccgccgcaatccctggagcacgctgagcccgtccatctggggaagcatccggtccaatattatcacatcatagggatattcagacgcataatagaatgcctcctgtccctgtccgcagcagtcagtttcatagcctgcctgttccagctgcagctttatggtaccacttaattccctatcatcttcaaccagcagaatcctcatgttcatacctcgcgccaccagtacccatgttgatgtgacgcggtaccggtatccttattgtattgaagcttgtgttaaatcatcaaaaacattatatcagacaaatctctaaaaatcctaaaagaaattcttccattttttaaggttttttagagatttgtctgatatgatacgggtatcacaaaaatcacggattatgagggagggatttgcaatgataaaaaagctgatgggcctttgccttacagcatgtatcatggtaacaggactgtgggggtgttcagcccctggaacgcctgaaacgggtacgtcaggggaaaaccaggcgcgccaggagaaggacatacccaggggaagatacgtggaaagcagtatcggcattcccctggaagacggggaacatgtggcggatgtgggacagacctgggataaggaactggaactatacacaatcagggataaggataagacagccatccggtacgtgtggaccggggatggctgggagaaacaggaagagagtatgatggaagggctgacatttccctatgacagcctgcacatgatatatggcggggatggaaaccgctatgtgttatatcagggcggggatgactacaaatgcaatatggccaggctgtcagaggggcaggcgccccaggcccttttggaacatgtattctcagtgaaaaatgaccggggatattacgacacgcaggttgattttggggctgttacagaagacgggacaatcctgttatcaaccggacgggaaacgtctgcatacagccagacaggggaaaagctgttctccctgcctcaggagtccggcgcatcagaatggaagacatccggtcttcttgccggaaaccagtatattaccaatggaagcaagggttttctggaatatgacatctccagccagtcagcggccgccacaaccgaatacgcgtaccggtccacggaccttagcagcatgtatgcggccatggcgccggatgggaaaggcgggttttacacggctgatccagagggtatccaccatatgaaccagggcgggagcctttgggagacagtggcggacgggacccttaactccctgagccttcccagtgcatacatcaggaaactgtttgtgggaaatgaaactgatttctatgtgtggatgtcccaatctgacctgcatgagataaaacattacacatatgacagggatatgccctccgcgccccttgaaacgctgaccgtatatggtctggacctggaaaacatgtccaccatacgccaggcggcttccatgttccagctgaagcatccggacgtgaaggtggagctgatcggagggcaggaaggcggcggcaacaccacggtctcagacaccatccgcgcgctgaatactgagcttctgggcggtaatggcgcggatgtcctgatactggacggccttccggtggaatcttacattgaaaaaggcgtgctggaggatatgcggggaatcctggagccgatgatatcctcaggggagctgatggaacaggccgcaggaccttatacgcaggcagataaaagcatataccatataccgtccagaatgatcctgttcgttgcatacggcgaccaagaggccataggaagcctgtcatccctggaagcaatgcggaactaccagagcgacccgtcctaccttccgttgcgtcctaagtgcagctatgagaatctgatgcggcaggtaatcgcgctgacctatgacgagattgtggacagcgccacgggtaagctgcgtccgggcaaaatccaggagctgattgagaccgtaaagatactgggggatgccagcggggccagggtcagctttgatgaatccgaggatgggggaagagggcgtgtctataaccgtgttgacagtgcggacggattccctggaagtgaattcgaccgtgtggaccggaacctgtcggctgccgccgtggataaagtaagagggatgtttgacatgccgctcctgctggcggtacagaaaaagaatgggtacaggatggagggtgtaaatgcatcctatctgccaaacggtaccattggaatcaaccaggcaagcccgaggaaaggactggcagaggaattcgtcctctttgtgctggggcaggaggtgcagtccagtgacctctcagacggcctcccggtgaataccagggcagtagacgtatgggtggaccgcggggataagggcgggggcttgagtgtgaccctgggcgacggttcttatagtatcaccggcagttcgcctaccagggaagagtgccaaatgttatttgaaaccgcggccatggccacgcacccaatcaggacggaccgggtacttgtggagatcatagttgatgagacaatgggattctttgatggaaccatgccgctggagcaggcagctgcaaatgcgcagaacaaagcggatctgtatttctcggaataggaaggcatggctgttcctggcccccagcctggcagggacggctgtcttcatcctgatcccgtttgcggatatggtggcgcgctccttcaggcaggcggttgggggacggttcgtgggactggctaacttcaggcttgtgctggagagccgggcattcctcctggcggccttaaatacgctgcgtttcatcctggtgtgcatccctgcgctgatggcattttccctctgtaccgccgtgatgatacagtcctgctccggacatgcatcaccggcaggcagagggggcaatgtctataagacctccatcctcctgcccatggccatcccggttgcctcggtggtcctcctatggaagctgtttttttatccccagggacttctgggacagctggccgggctggtggggctgtccggacaggactggctgaaccagccaagcgcgtttggcatcctggtggttacttacatatggaaaaatacagggtatgatatgatgctttggctggccgggctgaacgccatcccccaggaacttcatgaagcggccagggtggacggggccggtccatggcagtgcttctgcttcatcacactgcccgggttaaagggcacggccttcctgaccgcagtgctgtcaatcatcaattcctttaaagtattcagggaagcctatcttgtggcgggcgattatccccatgaaagcatctatatgctgcagcatctgttcaacaactggttcgtatccctggacatacagaaaatgagcgctgcttccgtattggtggaggcggcggtcctgataccggtcctggtgtgtgcaggcgtcttccggcgcagatacgccgaaaggtccctggatgactgacgcagggagggcctttaaggagatagcaatggtaaaacgtgtactggttaatcttatccttacggcggtgtgtctctttgtctggctgcctcttctgctgattgcaggcaatgcgctgatgtcagagggggaaatgctggagcgtttcggagccttgttcggggtgggcaattccccggtcaaggctgtgttccttccggagtatcccaccctacgcccttttgtggaactgcttctggactcgccgggattttatgtgatgttctggaattcctgtttgcagacaggcgcggtgctgggagggcagctgctggcggccctgcccgctgcctgggcatttgcacattttgggttcaggggaaggaaggctttgtttttcctctatatcatcctgatgatacagcccttccaggtgacaatggtgccgggatatcttgtgctaaaaaagatgcgccttttaaatacccatctggcagtcatacttccggggattttttccgcattcccggtatttatcatggctaaattctttgagtccattccaaggccactgattgaggcggccaggctggatggggctggggagttttccatatttgccagggtggggattcctgtgggaaagccgggaatcgtatctgtgatggtccttggattcttagagagctggaatgccattgagcagcccatgacatttttaaaagaaaggcggctttggcccctgtccctttatctgccggaaatcacatcggacaaagcaggggttgcctgggcagcctcggtcatcatgatgatgcttcctgtcatcctctttgtcatgggggccgaatcgctggaacagggaattgccgcatcaggaatcaaggagtgagcaatcaatatgaagaagacagcagtactgttcctgacaatcatggcagtcctgacctttttatccagggcgcttgacagcgttaccgttaccagggttgaaaccggatatgggaaacagggaatcgtatcctatgagatagaggggacaggggagttcgcggccggacgttttgtctatatcacactgccggaggacatgcagattggggaaatacttaagaggcccggccagaaggtacaggcaggagataccatcctcctgctccagatggaacggctggtggaagaaagggagaacctgtccctggaacttgagaaggcaaggcttctgctggagcaggaaaagctttccggcataccggttcccagggtgacggaggaaacattggccatgcagcagctggccgctgccaggagggcgcttgaagccggtcaggaagacctggcagaggccgaagaggattacctggtttccacagctgacctggagcatgactatgtgcagaagaagaaccggaccagggaagaggtaaaggaagataacaggagagccatgaaaagcgccaggagggcctatgaggcagcgcggctggccagggatgccgcggtaaaaaaggcggagcgcgaagtggaagacaggcagaaaaaactggataagctggaagcacgggaggatgcgccggaggaggacctggaacgggcgcagctggaactggagcgggcggaggaagacctggaggacatccgcgatgggcaggaccttgaggtggaagagaaaagggcggccatgtatgcggccgaggaaacatatgaggacatagattacggggaagagacagccagggaggagcttcgcaaggcttacgaagatgcggtaaaggcagaggaagataagcttaaaaacgcaagggatacggtcaaggggctggaggaaagcctgtaccggtccatggagaatctggagaacgcaaaggtgtccgatgccggcgtgatggcagaggaagcggccaggaaggaaatctcacggctgcgccaggaatccatggaactggatatacggcagctagagaaaaaacttgaaaaaacagatgccctgattgcgggtgaaggacgtgtggaggcggcggtggacggaatcgtggcggactctggattggaggcaggggacaggacccaggccggttcccaggtcaggctggcagtgggaaacctgaacctgattgcacagatggataaggataagtcagaactattaaaacagggtactaaaatgaaggtgaaaatcacaggacagtcaggggaggtggaggcagaggtggagtcggtggaccagacagcagggactgataaagcgcaggtgacggctgcgatgccggatggggagggaagccttgggggcagcgcatccttttccgtctatatggaatcagacatctatccgctggtaatccccatcgaagccctgagggaagataacataggattctactgtctggcggcagagcctgcgaagacaatcctgggcgaagaactgaccgctgtcaggattaaccttgaagtactggagaaaagcagtacaggagcagccgtctcaggaccggtggcccgggatgccaggctgattaccacgtcggataaagcggtcagtgaaggtgaacgcgtcagggtggtggggaaatgagaaaatggatttttttgctgctgctgttttccctgtggggatttggcgcggtgactgcgtggagcaccggggattacaggggacaggtttttatgtactaccgggaggatgacgcgccgtcacaggaggagcttgcccgtctggtcagccaggaaatcacggcctggaccctgacagaggacgtcttagtccaaaaccgtgaactgggaaagaagaagcaggcggaatgtatgtcggtccatggttccagggatatggcggctttcaggcgtctggtggatgggacctacggctgccggtcggaccgggagggctgtatcatcagcagggggctggccatggatctgttcggctccgtgtcagtgtccggcaaacaggtatggtgccgtgaccaggcatatgtggtacggggggtgacggatgattccggatacgtcatcctgataccggcaggtaaggaggaagggatgcgctgcatgatcatcagctgcggaaaagacagctccggcgaaacagcggcggaacgtatcctgttccgtcatgggataggaaacggctatgtgtgtgtggacggattcctctttttctcattttcctgcctgacagtgatgtctgcccctgtggcggtactgatttggctgtgccgggagctgttgcgcagaggggtgggaaaaagaaggcgtcttggtctggcaatcctggcattatccctgctttttcttggaatcctccttctgtggaagctggaactgaagataccggccgggctgattccggggaaatggtctgattttgacttctggagccggaaagcaggggaactccatgaccgtatggggaggatgggggaggcgtaccgggtggaatggctggaacaacttaaaaggaggaccatgatcagtgcagtatgttcccttggcgtctcgggcggattcctgatttggggacatttcgccggagggaaccgggaggggtaaaaggcttttctgcaattcaatgcagaggggcttttttataggatggattacaggataaatgtaaaaatcacccaacagccggattgtgtctgctgagaaagaatggtataatggctattgagaatttatcggctgccggatgaatgatgcggccagagggtgggggtgagccaatggaaaaagtccgccggttccttaatcataatatattcatattttccgtcaggcaggggcttctgctgaccataccattcctgatcatggggtcattttccctgatcatcatgaattttcctgtgaagatatggcaggctttccttgcttctggggcgggcagtcttctggatatgttcctgatggggatttaccaggccacctttggttcactgggctttatttttgccctgatgatttcgtatgcctatggggaggaacagacggtttatgacaatacccccgtgttctttccggcggtgtccctctgttcttttattgcgttctgttatcccagcggcgggctttccatctgggggcctgagtggagctttaccgcaatctgcattaccctggtcagctgctggctgcttaccatgatttaccggtgggttgcggggcatcagcgcctgtataccatgggggttgcctataatttcaatgcctccatgcagagcctggtacctgctgtggtcaccgttgccgtgtgcggtgtttcaggactgatattgtacctgttgtttgaagacgccaatatcatgaatttcggctcatacctgttcctgcaattatttgaacatctgggcaacggcatgttttccatcctgctctatatccttatatcccatgtcctgtggtttttcgggattcacgggaccaacaccctggaagctgtttcgcgcaggctttttgagtcagaggtggctgtcaaccagggcatgattgcccaggggcttgttccggaccgtatcttcagcaagacattcctggacacatttgtattcatgggaggaagcggctgcgccgtctgtctggttctggcgctgtttcttgcggccaggaaaaagaacaacaggcgtcttgccaaactgtccctgcccgcggttgtatttaataccaatgaactggtattgttcggattccccattatattcagcgcggatatgatactcccctttatccttacccccatcgtcctgtcggttatcagcggcatggctatctatttcagcctggtccccgccgtgtcgaacagcgtggagtggaccgtgcccgccctgttcagcggttacctggccactggttcagtgaggggcagcctgctccagctgtttaaccttgcagtgggcaccctgatttatatcccttttgtcaggcatagcgaggccatccaggaaaaggaattcctctccaagataaagaacctggaaaacaccatgaaggaagaggagcagtctgtatgggtcagggatttttactggaggacatatgagaacaggcagacagcaaagcttctgtcctcggaccttcagtatgcgcttatgaagggggagctgcagctgtattatcagccccagatgtaccgggaccgtacgctttatgggtgtgaggcccttttgcggtgggattatatggggcatacgtttatctatcccccgttggtgattgccctggccacccagggcggatttgttgacgaactgggattatccattgtctccatggcctgccgggacatgaaaatggcggagcaggagactgggcatccaattccattttccgttaatatcctgccgctgcagctggaggaccccggctttgcaggaaaggtggttgatattctgagggaaatgcatgtggagggcaggtatctgaccattgagctgacagaacaggtggccctgaatcccggcgccaacctggaacatcagctggaggagctgaagaaagccggaatccgtatcagcatggatgatttcggcatgggccatggttccctgaattatcttaactctgctgattatgatgaggtgaagattgacggttccctgattaaacgtctgcccggccatgcacagacctgtgagctgataggcaatatcatgaacatgtcccgtattttgaaagtcagcacggtggcggaatgtgtggagacagaggagcaggtgaaggtcctggacggacttgggtgcaggatttaccaggggtatcattacagcaggcccctgccccttcctgcgtttattgaatatgtgaaaatgctgccggaaccgggcgggaagtaaaggaccggatgggaagtaaggggccggatgggaagtaaagggccggatgggaagtaaggaaccggatgggaagtaaagaaccggatgcagcgtcaaaggatgggatggatgtaccttgaatgagggcatccattttttgtgatacaatcttcccggaaaaacggggatgatatgcacctgtcagaaagaaaaagttgacatatgtctaccatcatgataagctttaagtagacatatgtatacctaaaaagcattacatcacggaatccggagatggattgcaggggttatagaggaggtgtattcatggaggaaaacgggaaggtcagtctgtctgacggtgaatggaggataatgaacctgttgtgggagaatccgccccagaccatcatggaactgacaagggcgctgaaaaaggacaggggctggagcaagaatacagtcattaccatgctgaaccgtctggaggcaaagtcggccgtgcaccatgaggaagggcagcgggccaagcagttctatccatccattgaaagggcggatgcggccctgcaggagacaaagggattcctggagcgggtatatgaaggaagcgtcagcctgatggtggatgccatggcaaattcaaaatcgctttccaggcatgaaattgaagaactctatgaagtgctcaggaaggcagaggaggaaggcttatgatagataccatgatatcatcttccgtattgatattggcaattgctgcattgcgtctgatactgaaagataaaatcagtcccaatatccggtacggcctgtgggggctggtggtcctccgtctggcctggccggtgtttggtccatatatctatggcccccttaaggggttggcggacccattgcggtcgcggttcagtgtgatgaatgcagcggatgcggtccaccggcaggtgattgcgggaactagcctggaatatctggcagataatgtggctaccggccatgtctatcactttgacagtgcggggcagaccgtgacgctggcccaaagggcagcgggaattgactggcagctttggatcatggttatatgggtgttgggaagcatgcttctgggactgtggatgtttatggtcaaccggcgcttccacaggatgctggtcagcaggagaaaggtattttacggaaccatgccggtttttgtgacagaacgggtctatgtggtggaaggaatccaatccccctgttattacgggtgggggacggatgagggaatctatatcccggtttccgcccccgatgattaccaaaaactgtgccatatccttgcccatgagatgagccatgtgtccaatggggaccgttactggggaatcctaaggtgcgggctgttgtgcctttactgggtgaatccgctgatctggctggcggcagtgctgtccagacaggactgtgaactggcatgcgacgaggcagcggttaagcttctgggggaaagggagcggtttgcctatggaaggaccctggtgggcatgattgaggcgcggggaaggggaaaagggatatgttccgttgccaccacaatgacagccgggccgcggaccgtcagggaacgtatccggatccttgcggcacacccgaagacgaccggggccatgatggcggcggtggcgggagcggtcctgctgctgggggcatgtacatttacaggcagtgtggaaaccacagggacgcaggatgttccgtctgttgcggaaaatgttatccggggaattgatacacagtcccagccgtctcaggaacaaagggaaacagaggcagtgcccatcggacagggggatatgctggccctggtgggggtggagcagtggggaaatttctatgagctgaccatggaacggcgggaggcggaaagcggcaggccgctgcccgtcccacgtgattacagggaaaccatccaggtcacatcatatatggatgcggatggcactgtcctgtcaggggacggcagaccggaccgcggctatggttatatgcaggccggaccggaggaatttgtaatcagcatatggaatgcaggacatgcaggcgcgtttaagatatccattacacaggacgacaggagcgtggaatacctgtttacaacggatgacagggaattgctggacgcatatacctgccatcagctcatagaaggaccggaccagacccaggcagccttggtggcggtggaagagtaccccaatgcgttcagcatgcattttcagggagccgatgaggatgaggctgctggttttgcggacaatcaccagattgggatacagctggaaggatacggggatgaagaacacctgtatgagccggtaatccagcagagggatggaagggatatctatcttctgttctgctttgatgaagatgtgttccctgatgcggacgtcaagcgtgttgcggtcctccgggacgggctgaagtcaggcatttattctgcattgggcgtggacatgatttcatcaaaggtttatgacactgccatgcggttctgccgggcttatttaagcggggatgttaaaacagccggggaatgcagtacattttcccgtaaggagctggaggatacagtggccgtggatgactcagaactgccggaactgaggatacagtaccatccggacttaaaggaggtgtatgcggaagcagtataccggtttaaggaagaaggggaggacagctacacctacctgaaccttgaactgaagtatgcatatggggagtggaaggtcacatggaagggatttgagaaatagaaagggaccacgaagtgattccaatggcatcaaccagttcgtcaaattgtcgaactggttttttgcatcaaaaaaagcgcagagatacccctgtatttcaacactaactttaaaaaatatatgaaatatatgtttctatactacttctgcattctgctaccgttgcgtagtaaggtatccgggaccattatagagtttcttgattggaggattgcgtctgccatcaactctaaactttgctgttggtatccaggtcatccaacgcccccatctgcgataatgccttccaggtcggactggcacttttgttttggcaaaatccctgactaaactcgaaaggtattctgctggcataatctcacgctcatacatcttgaaatctgacagcagctttagaaaccggtgttctgcccgaagggtatctgttatgttcttcatgttgggaatatattcatatttgttggatggttctcttatgtgactgttttctttactatcttcacatgctgcttcataaaacaaaccgcaaactgagaaacaaagtatttttccataaatctcatttataacgatattatattttgtggaattaaaacgttcggcttccagatggtttttgatatcaaagtatacggtttcattatcccaacgctgtacatgataaagctctaagatacgttctgttgaaaatgagttagattccaggttcgtaaaataaatagagtctgtaacggtcgggggggtagtggttttgccatcagtcaatgtatactcatacgtattcctgatcacgcgaagtgataaagccccaacacgctccgcataagccctgttatcctcatatttcaaacgtttgatccatgcccgattaaaggggacttcgatgattccgtctctttcaatgctgttgacatactctttgtagaaatttgttttgcctcgcacaataaacttgtaatctttcagggcattatagaggaataaatcagcagaaccgtaatagcggtcacaaagcagaatgattttctttccctgaagaacctcctcgcaattctttaaatgttcaaatagcattgggagctcggaggttttgtatggcgctatgacagaatcaaggattacatgatttaaaacatcaaccagaatcgaacactttgcctgtggtttctttacctggctattatcttttatgtacatgtttgttaccccaccataataccctcttaattctgatgaattgggcaggtcaagtaccgagccatcacaggcaagtatcagataatcatccagtgtatgatattcctgatgcatatagaattctttggcaaaagagtgtatgataaagggaaacacatcgggattaagtttgtttagagccttaaacatagcctgttttgaaacgttcggtttttcaagctttgaaaagtaaagagccatgtccttgtttgtggtttcggcagaccgaaatacatagaaaagaagtacatcgcgcaaggatatctttcttgactgtgtaaatcctcgtatggttgttcttgcagcgctggcggtatcgggagaactgagaagccaatcaagtgcctccagcgcacgcttgatgtctatcatttctatactacgccccctcgtcatcataaatcagacgaggtttcttttttgcatacatagctttcagatacggcacctgatcattctcaagaaggccgaaattcttaagagtgcggtgtttaatcttgccatgatcgcggtaggattccacaaggtagcagaagcaggtattttgattgcccttgacattaggtacaactttaataaacatataagtctcctttctatactacaaatatacattaaaatacttattttatcaacttttagcaaaaaaccctatactacatttcgacataaacaaaagtcctgacccccaaaatggatcagaacttttgtttattttttataactggttgatgccattgggaccacgaagtgattcccatcaaagaaggagcctgctgttataatgacagcaggcttgtcctttgccgggagggcttgtaaaattaaagataatttcataattgtaattcacaaaccatggtaaaatattggtaataaatccaggaggcgcatgatgggaagaggtttaagggagagaaaggacttaaggcggaaatgccgttttacaaaaggaaaagcaccatggaccatgattattttagcaatggcactggccatgtctggactgtcggcatgtaatcccgctgccggcagggcggtggggacagacgtgcagggaacggaccatccggagtctggtccggagggggatggaatgaaagggatggatggtagcggtgaggaagggatggatggaagcaatgaggaaccatcagaatcctatgacacagaagggttttataatccgtcaggggaatctggaaaactggaagaggggtctgaaaaaccggaagcgggggatacaaaatcggaaggggagtctgcacaaccggaagcggaatctgcggcaccgcgccagctcaatgaagatgaactgcggtattttgaaaaatatctgaaccggattgacaattacggctttcttctgtctgaatacaagtccccggaatacctggatctgaatgaggttttttattcaggggcaggcatggaccagcctgccatgacaggggaagaaagggaggcgtttctcaaggcagtgggacagacggagataatgacggatatggtacatctgggcaaggcgcagattgatgcgttcctggcggataagacaggacttacccttgaccggatggagactgggcttgggtgggtttacctgccgcagtatgaccggtactatacggagcatggcgatacgaatatacgcagctttttctgccccagaggcgaggtggatggaaaccggtaccggatatggtgcctttccgacggatacacccagtttacccaggagtgtatagtgacccttaagaaggtatcatccgggtatcagttcctgtccaatgaaatcatatgggattatcatggataccgtaaggcagatgcgtcagaaccaacggcagaagcactccattatatcatatcggcttataaacggcagcttaaggaaggcaccacaggcgggtatcctgcggagggatatcctgtggattacggtctgcctgtctttgattcagactccagatattacacaagggaggaaatgcagcagatcagctgggcgccggagctgacagcggttttccgcaatgaggtttatgcccggcatggatacattttcaagaatgatttatggaatgattttttcagcgcctatacatggtattccggtatgtatcccgcagataagtttgatgcaggcgtgtttaacgaatatgagaaggccaatctggaactggcggtggagctggaacaatgatcagggaaaatccggcggggagccattttgggcggatggaaaggaagatgtttacgtgtccccagcattgcctgccggaaatccccccaaactgtctttggcttgtaaaatccaatccggtgctatataattgataggaaataaaggccctgcagcgcggccataaatccctgcataaaatatcggaggtagattgagatgaaaatggtaataattgaaccgcttggagtggagaaggataagcttttatccatggcaaaggaagcgttgggcgtccgggtggagattgtatatcacgatacaaaggttaccggcacagaggagctgattgagcgcggaaaggatgcggaaatcattgtggtatccaacctgccgttaaatgaggatgtgataaacgggtgcaggaacctgaaacttctggcagtggcatttacaggcatcgaccatattgcgatggacgcctgccggaagaacggggtcacggtgtgcaattgtgcgggctattccaccagcgcggtggctgacctggtgttcggcatgttgatcagcctttaccggaacgtgattccatgcgaccgcgtatgccgcgaggggggaacaaaggacggcctggttggctttgaactggagggcaagaagttcggtgtggttggaaccggggccattggactccgggtggccaggattgcccaggcatttggatgtgaggtgctggcatacagcaggacggtcagggatgtggagggagtccgcttcgtggaccttaagacactgttatccgaatgtgacatcgtgtccctgcacacgccccttaatgacgggacacgcggccttatgaaccgtgaaagcattggatggatgaagaaaaacgcagtcctcatcaacacggccagaggtccggtggtggattcggacgccctggcagaggccctgacagagggcaggattgggggagcctgtattgatgtgtttgaaaaggaacctccggtggaaacgggtcatccgctgttttccgcccccaacatcatcgtcacacctcacgtggcatttgccacaaaggaagcgctggtgaagcgggcagtgattgtatttgacaatgtggcggcatatctggacggcaccccaaagaacgtgatggggtgacaggttattataatggagtgatggttttatgaatgtggtcaggaaacatatcatattttccggacgggtacagggcgttggattcaggtacacggcatgctatctggccagttccctgggacttacgggatgggtgaagaatctgtgggacggggatgtggagatggaggtccagggggacgaagcatccatatcacgtctggtggagcggcttcatgaggggcggttcatacgcatagagcgcatggaaacagaggtgatcccggtgattaaagagagcagtttcagggaaatatattaagtatcagaggagtgtttatgttcggtttaatcgtggcagtgaaacaggtatatgataaatatgcagaggatgagatgactgtgtacgcggcccaggtttcttttttcattatcctgtccgtggttccgttcatcatgctgctgcttacagccgtacagatgataccaagcatcagcaatgcacagttcatggaactgattgtagggctggtgcctgtggattacaaatcccttgccttcagggtggtgaatgacctgtcccttaaatccccggccaccatgataagcgttaccgcaatcacggccctgtggtcggcgggcagggggatgttcagcgttgccagggggcttaaccgggtccatgggcatggggagaagcgctggtatgtggtgggtaggcttatctgctcgggatataccatcgttttcatattggtatgcatcctttcccttggccttctggtcttcggcaacatgatccaggcatttatggtgaaccgtttccccattgtagcggatgtggtcacccacatcattaatttcagggccctttgggcgctgatgatcctaatcatgttcttccttggaatctatacctttgtgccggataagaaactgaagctgcaagatcagattccgggagccgtgttttccacggtgggatggatggcattttcctttgcattttccctgtatttcaaccatatcgggggaaggaactattcctatatgtatggcagccttacggccatcgtgctgttgctgctgtggctctatatgtgcatgtgcatcctgtttttcggggccgagatcaattattactggaaagagctgtttgggagggaatgatgtcccatccctccttaaaaaagcggatgaaatcctgcccgatggaggacatggccctatccctttgccgtatcagcgtgatacgtgaagtgaagcccggggtggtaatggttttcacaagcattcccggatgcgcgcgccgggcaatggaagcaggagcaatggcaacaccgatgcccgtgccggcccacgtaaggctggtgcgggcatcgtcattgatgcacaggtaatcctggcgttcacgggggagcaggcggttcagctccccttcccagcgccgatagatgatcagcgggcaggtgcaaagctgttccaggctgatactgtctgccgccacatccgggaaatgtcccggcatccccactgccatcatgggttcttccgccagatagcagcattcataggaatcctcgggaaagggggtccgcacaatggcggcctcaatcagtccggtgttcagcttatccataagctgatacgtatttccctcgtagatacggaaataaatcccgggatgctgggcgcggaagtccgcgatgcgtccgatgatggagctggtttccgtggacgagaccatgcccagccgtaaaaatccgtgcagtccgcgtcccatctgctccatctcctgccgtgcggccccggccatgtccagtatcccctgggcgcgctcatagaacaccttgcccgcatcggtcagggcaatggcacgggaaccgcgctcaaagagtgtgacgcccagttcattttccaggagtttcatctgggtgctcaggggcggctgggatatatggaggattttggaagcagcagaaatgcttccttcattgacgattgttgtaaaatattccatctgtttcaggttcacggcacagctctccttatattaaaaacgtatatctgatatattaaaacaatattttaaatatggttactcctatgatataataccagacagtgtgggaaatgacaatattttagggcatgtccggaggaagcttcctgtttatatgaagcagcatatccggccatgttccgggaatggagcatcggtatgaaacgattgttaagctacatgaaggactacaggaaggaaagcatcctcggtcccctgtttaaaatgctggaggccagttttgagctgttcgtaccccttgtggttgccagcatggtggatgtgggaatcaggaaccgggatgggggctatatcctgaaaatgggcggcctgctgctgctgctggcccttgtgggcctggcctgttcgctgactgcccagtactttgcggccaaggcggcaacgggcgcggggaccgccctcaggaatgacctgtataagcacatcgggaccctgtcctatgcggagatagattccgtgggcacggccaccttgattacacgcatgaccagtgatatcaaccaggtgcagaacggtataaacatgacgctgcgcctgctgctgcgttccccgttcgtggtgtttggcgccatgatcatggcatttacggtggaccttcgctccgccatggtattcgtggtgaccataccggtgctctgcgtggtggtattcggcatcatgctggtcagcatgcccctttaccggtcggtccagagacagctggataaggtgcttctgaccaccagggagaacctgatgggagtcagggtcatccgggcctttaaccgccagaaaagcgagactgagaagtttgaaggggaaaatgaccgtctggtcaggatgcaggtttttgtgggcaagatatccgccctcctgaatcccgtcacctatgtaatcatcaatgtggccatcgtggccgtcatctgggtgggaggagagcaggtggacagcgggatccttacccagggcaaggtgattgcccttgtaaactacatgtcccagatactggtggaattaatcaagatggcgaacctgatcatcctcatatccaaggcaaccgcctgtatgaacagggtggacagcattttccaggtggaaaccagtgtgaaggaaggcggagggggatgtgaaggccgcggagagggaagccgtggaagtgaaggtcccgttgaactcctgtcatccatcagcccaactgccaaagacccggcacccaaggttgaatttagggatatggattttatatacagcggggccaaggcgccggccttaagcggcatttcctttaaggccatgccgggacagaccatcggtgtgattgggggcactggttccggcaagaccacgctggtaaacctaatcccgcgtttttacgatgcagacaaagggcaggtgctggtggacggcgtggatgtaagggattatacactggacggtctgcgctccaaaatcggcgtggttccccagcgcccggtcctctttaagggaaccttgcgggacaacatgaggtggggcaagaaagacgcgtccgatgaagagatatatgatgcccttaacatggcccaggccagggaattcgtgaatgacaagggccaggggcttatgctgcacattgatcagggagggcggaacctgtccggaggacagcgccagcggcttaccattgcaagggccctggtgcgcaggccggaaatccttatcatggacgacagcgcctccgccctggattttgccacggatgcaaggctgagaaaggcaatccgtaaaggtacggaggaaatgaccgtgttcattgtatcccagagggcgaccaccattaagcaggcggacctgatccttgtgctggacgagggaacgctggcaggcatgggaacgcacagggagctgcttaactcatgtgatgtgtacagggaaatctgcctgtcacagttatccagggaggaggtggaacgtgatgagcagtaaacagaataaacataaggattcagacaaaaacaagagcatggaaaccctgaaacgtatcctgaactatataggccagtacagatggggagtcatcatgtccctgatcctggccctcatcacggtagcccttacactgtacgttcccatacttacgggccgtgcggtggaccatattgtgggacagggaaatgtggactttgccggactgacccggatactgtggaaaatcctgggcgcagtgggactgacagcaatctcccagtggctgatgaaccacatcaacaacaccatcacctaccgggtggtaaaggatatccgcaccagggcattcaaccatcttgagacactgcccttaagctatattgacgcccacccgtccggcgacatcatcagccggatcatagcggacattgaccagttctcagaaggactgctcatgggctttacccagctgtttaccggtgtcctgaccattgcgggaaccctgcttttcatgctgtccatccatcccgccatcacacttgtggtagtggtgctgacccctgtctcccttttcgttgccagcttcatcgctaaaaaaacattcatcatgttccgccaccagtccgagacaagaggggagctgacagcgctgaccgatgagatgctgggcaatatgaaggtggtgcaggcatttggataccaggaggaaacccagaaacagtttgaggaaatcaataaccgtctggcaggttacagcctgagggccacattcttctcgtccatcaccaatccaagcaccaggtttgtcaacagcatggtgtacgcggcggtgggcattaccggcgcgtacgccgtcatccgcggcttcatgaccgtggggcagctgaccagtttcctaagctatgccaaccagtataccaaacccttcaacgaaatctccggcgtggtgacagagctgcagaacgccctggcctccgctgcccgtgtattcgagctgattgatgaaaaagccatcctggacgataaaccggatgccgcagagcttgcccacgtagacggtaaagtacaacttaccaatgtaaatttctcttacacaccggaccgcaagcttattgaaaacttcgacctggatgtaaaacccggtcagagggtggcaatcgtgggtccgaccggctgcgggaaaaccaccatcatcaaccttctcatgcgtttttacgatgtggacagcggttccatcaaggtggaagacatggacatacgcgacataaccagaaaaagcctgagaaccaactacggaatggtcctgcaggaaacatggctcaaaacagggaccatccgtgagaacattgcctacggccgtccaaatgcgccggaagaagaaatcatccgcgcagccaaggaagcccatgcccatggattcatcatgcggatgcccgaaggatatgacacggtcatcagtgaggacggaggaaacctgtcccagggccagaagcagctgctctgcatagccagggtcatgctgtgcctgccgcccatgttaatactggacgaagccacctcctccatcgacacaaggacggaaatccgtgtacagaaagcattcgccaggatgatggaaggccgcaccagcttcatcgttgcccaccgcctgtccaccatccgggaagccgatgtaatcctggtcatgcgtgacggacacattgtagaaaaaggccggcatgaggagcttctggagcgggggggattctatgcggaaatctacaacagtcagtttgcgcgggggtgattttgggtatgtatgtgggggtgtgtgaaggctacgcccccaaagcggtccagggccgggcggccgggcgcgggttggaggccaagttccggaggggcagcttctaaggccctgacagattaaaagacgggggaccggtgctattcacgtagaaatcctgaaggactttctacgttcagagcaccttggattcttgctttgatgcaagaatccacccccgtcttttaatccgccagaacctaagaagctgcgacctcctccactatgcctccaccccgcccccgtccgcccggccctggaccgcttcgcgggctgtgcattccaaccgctacatacgcaaaatacaggagagtggatataagcgtgcggggatataatcaggataggatcataatcaggataggattatatttaggataggatcatatttaggataggatgcatacttaggacaggatgtatacttaagataggatatatatttagaataggatatatatttagaataggatttatggacgggagagggggattacttcagcatgcgaccctatcccgctatccggattcatgaggtggagcaagtgggaaagcgtagtgggtgagtggaatggggatgggagggatggatgcatctacaggggcgtgcaggtcttagtcttcgggaagcggtgctaagaggccggcgtcctttgtctgagcccgatatcaaaatcattggaaaagccagagcgcgagtttgggcgccggcctcttgtccagcgccggttcccgaaggcttagagctgctagccccgcagcccgcgtccatccctcccatccccattccactcacggacggaatcccccacccaccccacccataaatcccctcatcttaatacaatctttagctgacaattccccattttttatgtataatacccattagaaccaatcaaactaataaaaaacggaggaacaaaacactatggaatctgacccggaagcggccaatattatattccaaatcacaatcttaattatcttaacacttatcaatgcattctttgcaggctcagagatggcagttgtatctgtcaacaagaacaggatccgccgtcttgcagagcagggcaacaaaaacgcggcgcttatagagcggcttatggaagactccactgtctttctgtccaccatccaggtagccatcacgctggcaggatttttctccagtgcatctgcggcaaccggcatcgcccaggtattggcggtgaagatggcagaatggaatatgccatacagccagacactggcaggcgtggtggtcacgctgatactggcatattttaacctggtgttcggtgaactggtgccaaagcgtattgcccttcagaaggcgcagggattcagccttttctgtgtacgtcccatatactatatctcccgcatcatgaatccgttcataaaactgctgtcactgtccaccagtggcttcttaaagctgattggcatgcacaatgagaaccttgagacagatgtgtcggaagaggaaatcaagtccatgctggaaaccggcagtgagacaggtgtgttcaatgatattgagaaggagatgattacatccatattctcctttgacgataagcgggcaaaggaagtcatggtccccagacaggatattgtggccattgacattaatgagcctctggaggattatattgatggggtcctccagtccatgcattcaaaaatccctgtatatgaaggggatattgacaatatcatcggtgtattgtccatcaaggccctgaccatcgaggcaaggaaaaagtcctttgagggactggatatccattcccttctcatggccccctactttgtgccggaaaacagaaggacggacgccctgtttagggaaatgcagaagaataaaacaaagcttgccatcctcattgacgaatacggcggcgtggccggtatggtgacactggaggacctgattgaggagattgtgggtgacatccatgaggaatatgaagaggtggagcctgaaatcctggaactggagccacaccgggtttaccgggtatccggcagcatttccctgttcgatttaaaggaagagatgcatctgcatatggatagttcctgcgataccttatccggttatcttatggaacagctgggctacatacctggccagacggaacttcccatcacggttgtgacagctgaggcggactatgaggtggaaggcatggacgaaagggtcatcagctatgtgaaaatgaccttaaaggagacaaaaaaagaggaagcggctgaggaaatatagccgtatacggcaaggaggaaaagaacatgggctttttgttggacggagtcatggcagttacatggcagcagatgtttatgtatgccataggaattggtcttatctggctggcagtgaaaaaggagtatgagccgtccctgctgcttccattggggtttggtgcaattcttgtgaatctgccctattccggtgtgatagaccagatggtgcagggaaaagtgcctgcggccggtatcattgagtggctgtttaagaccgggatagaggcatcggaggcaatgccgatcctcctgtttatcggaatcggggccatgattgattttggaccgcttttaagccagccagtgctgttcctgtttggggcggctgcccagtttggtatattcgtggccatccttgtggcctgtatgctgggatttgacctgaaggacgcggcgtctataggaatcatcggggcagcagacggacctacctccatcctggtatcccaggtgcttaaatcaaattacatggggcctattgcagtggcggcgtattcttatatggcgctggttcccatcatccagccatttgccatccgccttgtcaccacccacaaggaacggtgcatccatatggattataatccgaagagtgtgaataaggccctgcggatttcatttccaattgcagtcaccatgattgtgggactgatttcaccccagtccgtggctctggtcggtttcctcatgttcggtaacctgctgcgggagtgctgtgtgttgaataccctaagccagtccgcacagaatgaactggcgaacctgataaccctgcttcttggcatcaccatctccttcagcatgagggcggagcagtttgtaaatcctgccacccttatgatcatggctctgggattgctggcatttgtgtttgacaccatcggcggcgtgctttttgcaaaacttgtgaacgtgttcctgaaaatggcgggcaggaaaccggtgaatcccatgattggcggctgcggcatttctgcatttcccatgtcatccagggttgtgcagaagatggccgcgaaggaggaaccaggcaacatcatcctgatgcaggcagcggggaccaatgtttcaggccaggtggcatcggttatcgcaggcggccttgtaatcagccttgtaacccagtatctgtaaaggtatcaaaggaggatggaatcgatgaatatggcaaatgtggagattgccctggaaatcatggcaaagggcatgggcggaatctttgtggcaattgtggtaatcatggcggcggtcatggtgctgggtaagattacaggtaaaataaaggataaggaagaggaatagccgataggtaccgggcggcgccagggtgtgtttcatgattgctcatataagacttctggggggccggattattggaatgaggcattgcagcaaggcattgcagtaaggcattgtaataaggcattgcaataaggcattgtaataagacattggaatgaggcattggattaccttgcaggttatccggtgccttttttctgaaggtatttttgcggaatgatgggagggggttgatacggctggtaatattaggtacaataggggggaagctgactttttgtaagatatggaaggatatatccccatgactggatgcatcaaacggaaaggaaggagaaaacaagacaaaaagttttgaactagcttaaaaacaggataaaatatgtgaaatatacataaaatatcatgattaaaatggtatataaagtacaaaaacacaataatcttacaaaaagtctttacggcagacaaaaagtgtgctattatacaatcagaaaaggaaacagggatatgaaagagttgaaagatgaaaaaaagtttttaacacagttgatggacatgctggaacagcagctgggtccacatacagaagtggtcctgcatgacctgaagaaggattatgccaacacaatcgtggacatccggaacggtcatataacagggcgtgagataggaggcacgggaagcaatctgggacttgaggtccttcagggaacggtaaaggatggcaatcggtttaattacatcacacaactgagggataacaggatattgaggtcctcgtccctgtacatcaaggatgaggaaggcggtctgatcggatgtctctgtgtgaatacggatattacagaaagcgttaagctggaaagctatctgaaggaaatgaaccactatgatatcaatgcaacagacaaacaggaagtatttgtaacggaagtgaatcagttattggaatatcttcttcaggaaggccagaagctggtgggcaaacccgcaggcgtcatgaacagggaagaaaagctccagttcctgaaatatctgaacgataagggagcattcctcataaccaaatcaggagagcgcatacagtcatttctgggaatatccaaatataccatgtacgcatatctggatatgataaaaaaggaagaagcaggaacaaaaactgaataaacgggcagcttgttaaccagtgccacctggtgtggatgatcaggatacagaatctgtcatctgcgcaggacgacacaagcagcacaataaaatacaccggaaccggattctttttcagggaattgaagaaggtgtattttttgtacccaaaattccgtgaggattttggaatataaaaaaacaggaggaggatgtacgatggagaaggttgtaatcaaaaccgacaaagcggcaaaaccagggggatggtactcacaggcttataaggtgggtgacttgatatatacggcaggtattaccgccaatgacccggttacccaggaaatgattgcgccaggagacattgcagggcagacggaacaaattattaaaaacctgaaaataattttagaagaagcgggatcggatttggagcatgtagtgaagacacttgtttttgttaaggatattgatgagtttgcaaaatttaatgaggtgtataaacagtattttcctaatgatccgcctgcaaggagtacaatgcaggttgggaaatttaatggggatatggtaattgagatagaagcggttgctatttgccgataacgagaaaaggggtgggaaaatggatgcgaaggaacgggtgaaagctcttgtcaaggatgaagaagcgattaatctggtaaggaatatcgtgcagatacccagtcactgggcacaggaaaaaagggagaagccgatatcagattatctgttggattattttatgaaagcggggattgacgcatatcaacaggaagtctatcccgggcgtcccaatgtggtggcagtattacatgggacaggagaaggaaagagcctgatgtttaacggacatatcgatactgtgccgccttttgggatggaggatccgtttggagctgtaattaaggatggaaaaatgtatgggcgtggtactgctgatatgaagagcggtgtggccacaatggcatacgccatgaaacttcttaaagatgcagatgtgaagctgaagggggacctggtgtatgcaggagtaattgatgaagatgcggctggaagtgaggggacacgctatatagtaagaaacggacctttgacagacctggctattgtaggagaacccacatccctgcaaccggtggtggcccacaaggggtgcgattattttaccgttaccttctatggacgatccgttcattccagcgttccctggaacggcgccaatgccaattacgcagcggcagagttcatacgcagggtggaaaatgaaatgattccggagtggtcttctaaaaagcatcctttctgcagcccgcccacgattaatgtcggattagtccagggagctgcaaaagccaatatgccttatcttttgggtgaaagccctacatttgcaggtattataccggatttgtgtaaggtacatatcgatgtcagatggatacccacgcagacaatcaagggaattgaggaggaatttagaaaattagccgaggaagttgcctcaggacgtgaaggtatccgtgcaactgttgaatttattgacatgtacaggcctgcaatggagatatcaccagataatatactggttaaatccattcaaagcaacagtaagtcagtgctaaaaaaggaatatcctataaagggagaaacgtattggggagattccggattgctatgcacattggcgggtatcccatccattatgtatggaccgggggacattggctgtgcacattcggatgtggaatgggtagaaacaggtgagctggctaaggcggccctgatttatgcattgacggcaattgacgtatgcggtgtggcagagtaggagggagaaacgtggggttatgttatgatttgttattggctggcggggatgttgtttttgaaaatggggtcaggaaagccaatatagctgttaaagatggaaaaattgcggcaatcctggcacctgggtttgtggttgaggcaaaagagataaagaaaattgagggccttacggtatttccgggactgattgatacccatgcccattattgggaaccaggtccccagaattacagggaggattttcatcacgctacaaggtgctgtgcaaggggaggcgtgacaaccaccctcgaaatgccccttagtattccgcctgtggtggataagacatcatttgaactgaaatacaatgttgcaaaagaaaattctgtcattgattttggactatggggaggctgcatacctgcatccatagaccgtctggaagagatggatgaactgggctgctgtgcatttaaggtatttatctcctatgccaatccggattatccccatttgccggaccatgaattatgccgtgcaatggaaaaggtttccaaatttggaggtatgattgcagtacatgctgaaaatgcagatattgtgagtaatttctgtcaatggaaaaaggaagaaggagtccggcagccatccaggtatcatgaaggccgtccagctttttcagaggtggaagccattcagagggccgttctgttttccaaggtatatggaacggatttgctgatctgccatatgagcgctgcggagggagtggatgcaaccctggaggccagaaggcaggggcagcatgtatatacagaaacatgccctcattatcttgcatatgacaatacccgtatggatgagtgcggtgcatttgcaaaatgcaatccgccaatcaggccgagggataatctggagcggttatgggaacatgtactgaacggtaatattgatgtgattggaacagatcatgggccgtattctaaggaagaaaaactggaggcggataatatctgggatgcattgccgggatttggcggtgttgaacttatgctcaccatcatgattacagaaggatatgtaaaacgcggcctgcctttgcaccaaattgccaggatgacatcgattaatgcagccaggattttcggcctgcagcaaaaaggggcaatagaagtgggaaaggatgcagattttgctattgtggacttaaacaggaagtgggtttatgaaggaatgaaatcattttccaaaacattactggattgcgggatatttgaggggtatcattctgaagcagctgtctgcgagaccattgtacgaggttccactgtttataaggatgacacaattaccgtggattcaggctatggtatgttcataccacgccaaatttaatatattccaaggaggaaaaagaatatgaagaaaacaaagaagtggctcacgttagttatgtgtatggcaatgctggcagcatccatgggcggatgtggaggatcaggtacagccgctacccaggcaccggcatcagccgcgggtacggaagcaaaaccagacaaccaggaaaaagaaactgagaagaaaacagaggataaaaagagcatgaaggctgctttggtaaccgctcagaaattgggggaccagggtgttacggacctttgccacagtggattcatgaaggcggcagatgaatatggtatggagacccagatagtggaggtacagaagggcgaatatgaggaaagtataagggcactttgtgaagatggatatgacatcgttgttgcattgaatgtggaactggtagatgcaacttcaaaggtggcgccggattatccggatgtggattttgtactgaccttaggtgaggtagaactggataatttaaagtgtctgttaggacaggaacatgaaggctcttatctggcaggagtagaagcgggtatgattaccaagacaaaccatatcggttttataggcggacaggataacgctgagattaaccgtttcctggcaggttatgagcagggagccaaatccgtgaatcctgatatcgttgtggatcctgtgtatgtaggttcctttgaagatcccacaaaggggaaggatctggcattaatgctgtataaccagggatgtgatattgtatatgctgcggcggctaaatccggtctcgggatgtttgacgctgcaaaggaaacaggaggactgtgcatcggtgttgatgttaaccagaatgatgtgcttcccggacaggtcatcggttcaatggcaattgcatatgaccaatggatatacaatgccatgaaggaaattgcagaagataaatttgaagttggcgtgttctggtatggattggaaaatgataatgtgtatctggcgcttcctaccaaagagcagtatgatttgccagaagatgtgctgaaagcagttgaggatgccaaagaaaaggtggtatcaggagaaataacagtagaccctgttgctgaaaaagataaatagaacctggatgacgttttgcggcaatgaaaaacagcattgccgcaaaaatgacactatggtgaaaggggagcaaaaaagtggcattagcagttgaaatgcaggatattaccaaaaagtttggtaatttcactgccaatgataaagtgaacctccagttgaagtgggctgaaatccatggcatttgtggtgagaacggggcaggaaagaccacgcttatgaacactctttacggtctgcatcagcctactgccggggatatatatattgatgggaaacgggtaattatccacagtcccaaggactcgattgccctggggattgggatggtacagcagcactttagccttgtcccgtcaatgacagtggcagaaaacatagtaatgggaaaacctcctcacgcaaaaaatggtttgattgataaaaagaaaagcattgaaatcgtagaagaaatcagcaagaagtacaatctgatagtaaatccgtccgctttagtcaaagaattgccggtaggcctgcagcagagggtagagattttaaaagcattatatctgggagcaaatatattgattatggatgagcccacggcagtattgacgccacaggaaatcaatcagctgtttattaccctggatgaattaagaaatcagggaaaatccattattttaatcacacataagctttcggaagtcacagccattacagacaggataactgttatgcggctgggcaaaacagtggggaccatagatacaaaggaaaccacggaacatgaaatcgcccggatgatggtggggcgtgaagtgttgatgaacgttgaaaaagacatatctgagccaaaggaaatcgtattagatgtgaatcatatatcctgtagtaatgaccagggcattcctgctgtgaatgatgtctccttttgtgtgcggcagggggaaatagtaggcatagccggggttcaggggaacggccagaccgaactgatagaagcaatcacagggttgcggaaaatacgcagtggcaaaatcagcataggcggcaatatcctgggtggaaagaacacatccagacagtgcagggaccttcatgtggggcatatcccagaggacaggcaggaggtgggggctgccagatatgcaagcataagggataactatcttctgtatctgcacacactgagacggttccataaagggatattcctgaactataaggaatttgacaaggcttgtatagaggggttggctgagtatgatgtgagatacaataagattcaggataatgccagctcactgtcaggaggtaatctccagaaactgattattgcaagggaaatgtataccaagcctcatttactggttgcggcacagcccactaggggagttgacataggagccacggaattcatccataaacagattgtggctcagagggatgcgggaagcggggttttgctgttttccaatgaactatcagagataatcagccttagtgaccggattcttgttatgtacaggggacagataataggtgaagtggaccagatccatgcaacggaagaaaaactgggtctgtggatggctggaataaaagatgaaagatgataggaggataatgatttgagcttggagtttaaattaagaccggttaatataaagacaatcatatcagccatcataatctcttttctggtaggcggtttgattgtgctgggcagcggatataatcctgcggaggtgtattataaactatttaaaggagctttggggagtaaatttgcgattgcatccactttaagatggatcacgcccctgttgtttacttctgttgcatccgctattgcgtttagaggcggtatgtttaacatgggagttgagggccagctgtatataggggcactggctggaaccattgtgggggtttcctgcaagggccttccgcatctggcacatgttgccctttgttttttggctgccatgacggctggtatgttttatgccatgatacctgcattgatgagggtctatctgaatgccagtgaggtagttacaaccctgatgttgaattatatgataataaatttaaacaattttatcattcaggagtatttccttgcaacagacagcatggtttcgaccattgccaccaatgagattgaggcgagtgcaaagctgacgtctatcatgccgccttactcagtcaataccggacttataatcggagcgttcatgattgtcctgttttatatactgttcaataagagtaaactgggatatgagttccatatatctggcgtaaatccacaatttgcaagatatgggggaatccaggtggaccgggtaaggataggtgtcatgctgattagcggatgtattgccggattaggcggagctgttgaaatcatgggggttcaggaacgtctgatggcaagcttttctccaaatttcggatttgacgggatgctggccgccttgcttggtaatagcactcctcttggggtaacattatcttccgtattctttgggacgctgaaagcaggggcattatccattgaaagaactacagatgtatccagggctttggctgatgtgattaagggtatcattatctgttttgtttctgtcaggacgctggggttactggacaggatttcgtttagatggccgggaaaccgcgtattgcgaaataagggggaaggaacaaaggaggtaaaaaatgtttattaatgctacacttttagcggtagttgcacgagttacaacccctattgttctttgtgcttccggcggattgtattgccagctggcagggactccgaatataacgttggaaggggccatgttgatggctgcatttgctggagtggcaggcagctattatacaggcagtgccctggtggggttgttatgtgctatattaggttcgcttttaattaatcttttatttggcttcctgcatcttaggctgggcggagaaggaaccattacaggattcgctattaattccctgtgtcttggccttaccacattccttttacggtccatgtttaatgttacaggaacactggtggatgaccgcatcgtaggattaccaaagtatagtatccctatcctgaaggatatccccatcctgcagcagctgttcaccaaccataccctgtgtacctacttttcctggatatttattatattgacatatatcattttttacaggacaaaatatggtatgaatataagggcctgcggtgaaaatcccacagcagcctcatctgttggtgtgtctgttacaaccataaggtggagtactatcatgatttcaggcattatgagcgggcttgcaggcgcacagatatccctggggtatctaagcatgttttctgagaatatgacatcaggcaggggatttattgctttggctgccatcatgctttctggcggaaggcccattgccatgtttgtagctgccttgctgtttggcgtggcggaaggtctatctaaccaggcacagctgacagcgatatcttcgcacttaatcctgacattgccatatctcatggtaattgttgtgctgttgctgcagccggagcagatgaaggctttaaaaatgcggatcagacagatgaaaggataagggaaggatatgcgtttagatgggaaatgtatcataataacaggggcaacaggagggattggcagggcggcagcagagttgttccatgaagagggggcaaggctggtcctgtcagatatagatgtggataagggggaagcgctggcatcacagttatctggaagccattttgttcccgctgatatctgcgattcgggacaggtgaaccgactgttcgaggaagcggtggactttatgggtaagatagatggcctgtttcacactgccggaattgtttcttcctctgaccttttttcctgcacagaggagcattttgagaaaatcatgaatgttcatcttaaggggacgtttctttgtctgcaaaaagcagcgctgaatatgatggaacagggcggttccatcgtgcttacggcatcgcagcgtggaatcctgggtgccactggctccattgcatataatgcggctaaaggaggtattgtaattatgggaaagagtgcggcaatggaactgggaaaatataatatacgggtaaatgtcctttgtccaggtgcgacagaaactccgatgctcaggcaggatattgcaaacagcccgaatccggaggaattggagcaacgcatgctcagtacatatcctttagggcgttttgggacatcagaggaatccgcttatggtgctctttatttaatcagtgatgaggcggcattcacgacgggtacgacattagtggttgacggaggcaatactgcaggataatcaggaggttgaaatcatgaggattttattggtagggggaagcgggctggttggcaccagactcgcatcctatctggcagaacaggggaatgatgtgatatgttttaaccgcaccataccgcgcggcgtatcggaacagtgtatatatgagacaggtgacctgggtgaatatggcctcttgtatcaaatcatgaaaaaatacaggatagaacaggtcatacataatgcggctatttcccatcccatgctgtatagggacaatccttataaggtttaccgtgtaaatgtgacaggaaccttaaatgtattagaggcagcaaaactctttgatgtcagccgttttatctacattagttccggtgctgtatatggaaacacggatgcccctgtggtgtatgaagaacagaagcttcatggggaaagtccttatggcgcttccaaagtggcttgtgaggagattgtgaggaactatggggtgcagtcagcttctctaagggtagcctttgtatacggtcctggaaggagtatgtcatgtccggttgaacaggctttgcgccatgctgtaaagggagaggaaatgctgctggataaaggcgctgaccagaagatggattacatttatattgatgactgtgtggaggcaatcgcccggattgtcagcagccgtacattacactatgatgcctataatataggcggaggacagctggtaccttatagccgggtgattgataaagtaaaggcactgtatccccggtcccggattgaagtgggggccggcggccttggttatgatgatttgggagcaatgtcaatccggcgtatagaagaggatacgggttggaaacctggcatatcaattgaggaagggatagaaagatatgctttatggatggagaagaatatataaactgacggatgacaagaatgtgatatgaccgaacaaaaagaaagggttggattttggcagtgcggccaaacatccaacctttttaaatccttatttatcctccaccaaaggaatcggagtctcatccttctcatccagatgcgccagataatacttcgtatccttcacaatcacgccggacagcagcagcacggcaatcaggttaggaatcgccatcagtgcattaagcgtatccgcaatactccatacaagctccagctggattacaggggcagccaccagcaccacggcccaggccacgcggtaaggaatcagccctttcttgcccatcaggtattccaggcaccgttcgccgtaataggaccagcccaggatggtggaatatgcaaatgtgatgatacccacgatgaggatgggctgcccgatataaggaatcagggcaaatgccgcattggtcagttctccgccggacaggttggtgacgctgatggaatcatagccaatgatgctgctgaccaggacaaggccggtcatgagacagaccacgacggtatcccagaaggttccggttgcagatacaagggcctggcgcaccggattgcgggtctgggcagcggcggccacgatgggggcggaacccataccggattcattggaaaaaagcccgcgggcaattccgtaccgggccgacatcatgatacccgagccaaccagaccgcctgcgatggagcgcatttccgtaaaggcgctgcggaatatgatggaaaatgtctcacccaggaatgcccggttgatgaagaggatgaaaatgcaacccacaacatagaaaaacgccatgaaaggcaccagcttttcgcacacccttgcaatggatttcaccccgccgaagataaccaggcaggtaaccccgcttgtgataaggcccactgcaaggctgatgatccaaggatatgtatccagcagggccttaaggccgccggatgtcataagcggtttcacattgctgtttacaatactggaaatggcgttgacctggacgccgcatccgattccaaaggatgtaagggtgcccagcactgcaaagatgatgcccagccacttcatgcccagtccgcgctccagggcatacatggcgcctcccagcatggtgccgtccttggtgcgcacgcggtacttgacggctatgagggattcaccgtacttggtggcaatcccgaacacgccggtgagccagcaccacagtacggcgcctggaccgccaagggcaatggcggtccccacgccaatgatgttgccggttcctatagtggaggcaagggcggttgtaagggctgcaaactggctgatgtcgccgctggagtcgggatcttttgtgacagagagccggatgccggtcaatgttttcctctggatgaatcccgtacggatcgtgagaaaaagatgtgttccaaaaagaagtgcaatcatgggaatcccccaaagatagttattgatggtttccacaatggtgctaaacagttccatatcaaatcccccgttttctgagtcaataatattaataatttagcacagtaaaatggaaaaagcaagaaaatatgttttcaggccaaaatagaagggtaaaacagaaaatattttgaaaaaatataaggtaaacagaaaaagttacggaaggatacgaaaacacggatacatggctaccttgcagggaaatggaaaatcatagaacgggaggggagggaaaagataaaaaagtaagaaactgaccgaaacaagcaagaaactgaccaaaaaaatcaattggcataatgcggcagggcattatataataaaggcagtgtatgaatccggaaaagaatggggagtgataagcatgatgcttttttacagaatgtgtctgttctaggtatggagtaagtacccgaaagggtaaatctaaagcccataccagggataagaatggacagaagtttacaaaaggagtttaacggacaggtcagcgaatgggaatgggagctgtacaggcgcaatatgaagcggatgtacaagactgccaggaactgccgtgaccccagggaaaaggccctggaagactaccgccaccgccgcggcaccaaatggttttataaacatgagtgcaaggaagtaagaaggcagaccaggagaagcctgcgcacaaaactgaaacgggaactgtataacgaggcatattacagggttgtccctcatgactataagacatatggatggcttacctggtgatggaaaagcgcttgtaatgaaggagggaaatcatgagactgaaaaaagcagcattaacggcatccgtcatgatttcctgcctgtccttcctccagccgccggaaacaaaaatctatgaggaagacctggcgctccgttatgggcggcagctgacagcggttttcggggaggacagccggatttctcccggggaaaccatcacagggtatttctggaataaggatacggataaaccggattggaacaagccatacagatataccaggtgggaactggattacacggatgcctacggatgtccggccgcttttgtgttcagcaattctgcggaaaatatcacaggggctgtccgcagccaccttaaggccagggtagaagcctactatgatgagaatttccttcagccatatatcgtaccatatgtggatgaggacagtgtttcaatgtactgcagcttttattcgctgttttccgaccggaaacgtccggagacaagtataatgtttgaggaacggcttcaatatgaaatggatatactggaacatgccagactggatgaaatgcggtatgaaaccgtatttgatgagtatccggtaaccctttccatgtacggctatgtccgctacggggacctgtccgcggcagaacggcaggagaaagtggatttccttgaggcgcagcttaataaaatgacggatgccatggtccggtataccggcggctgcttaaacggcagcgtcggcatcacgtttctggatggggatgggcctgatgccgtcatcggttaccagattcttaaaggagagatttatacaggtgaagattttgaggtggacctgcaccaggcatttttcggccctattgacctggatggggcatgagggatgcggatcatggtggcagcggattatggtgacagtgaatcatggtgacagcgtatcataatggtaccgtacaaatcaaaagccggtcccctgaagggaatccagccagggcattttaagacatgccctgacggttacccgttttcaggggaccggctttgatattggtcttatacattaaaacggaagagaaccacatccccgtccctcatcacatattccttgccttctgagcggaccaggcctttttccttagcagcgcccatgctgccgcagttcatcaggtcgtcgtagttcaccacctcggcgcggatgaagccgcgctcaaagtcgctgtggatcttgcctgctgcctggggcgccttggtgcccaccttgatggtccatgcgcggctttcctgaggaccggccgtcaggtagctcataaggcccaggatacggtagctggcggcaatcagcttctccagtccggattcggtaaggccaaggtcatctaagaacattttcttctcatcctcatccaactctgcgatttcctgctcaatctcagcacagatgacaaatacctcacatccattttcggcagcaaaaccgcgtacggactgtacgtagctgttgtcagcgccgtcatttgccaggtcgccttccgcaacattggcagcgaatatgacgggcttccaggtgagcaggttcaatgttccgatgaattcgcgttcatcctcatcctctgtctcgtagctgcgggccagcctgccttcttccaggtgggctttcatggcctttaacagttccacttccttggccagatccttattgttgaaagcgcccttggactgctttgcaatgcggcgttccagaatctcgatatcagagaaaatcagctccaggttaatggtttcaatatcccttaaggggtcgatacagccgtccacgtggatgacattggggtcgtcgaagcaacggaccacatggacaatggcgtccacctcgcggatattggacaggaactggttgcccaggccctcgcctttggatgccccctttacaagtcctgcaatgtccacgaattcgatgacggcgggagtggttttttcagagttatacatttcagtgagcctgtccagacgcacgtcaggaacaggcaccacgcctacattggggtcaatggtacagaacggatagttggctgattccgcgcctgccttggtcaatgaattaaaaagagtactttttccgacattgggaagtcctacgatacctaatttcatatgattaccttcctattataataagtaattacagccttattatcatatcataaaacatgggggaatgaaagcagaaaatgtttaactgccaaatgtcaataaaatcaggtttggcgggaagaatataagcacaggcacatgaaggacatgaagcaatccaaaacagtttaaggagatacaagatgggagagacaatcgtagtaatcggagccaaccacgcgggaacagccgccatcaatacaatactggaccagtttccgggcaaccgcgtcattgcatttgacatgaactcaaatatcagtttcctggggtgcggcatggccctttggattgggaaacagatccaaggcccggacggcctgttctattccagcaaggaaatattcgaggaaaagggcgcggccatccacatggagaccaggattacccacattgactatgacaggaagatcgtgcatgcgcgggacagcgccggaaaggactttgaacagtcctatgataagctgatactggccacaggatccatacccatccgcccggagataaaaggcatggacctggaaaatgtccagttcgtaaagctgttccagaatgcccaggacgtgattgagaagttaaaggatggatccatccgcaggattgccgttgtgggggcaggatacatcggggtggaactggccgaggctttcaggcggaatgggcgtgaggtggtgctgattgactgtgcggatacctgtttatccggatactatgacagggagttttccgatatcatggcaaagaaccttgagagccacggcgtaaagctggcattcggggaaacagtaacgggactggaaggcggcgggaaggtccagaacgtcatcacggacaagggaagccatgaggctgacatggtggttttcggcattggatttaaaccaaatacagtgctggggcagggacagctcaggctttataagaatcatgcctttttggtggaccggaagcaggaaaccagtattccgggagtctatgccatcggtgactgcgccacggtctacaataatgccatccaggccacggactatattgcgctggcaaccaatgcggtccgctcgggtatcattgcggcccacaatgcctgcggccggctgctggaatccccgggcgtgcagggatccaacggcatcagcatatgggggcttcacatgctcagcacgggaatcagcctggccagggcaggacggatgggatatgcggctgccgtgacggattacgaggactggcagaaggcggagttcatggaggatgggaacaaccgtgtgaagatacgcattgtctatgacaaagataccaggatcatactgggggcacagatgtgttcagactatgatatttccatgggcatccacctgttctccatggccatagaagagcaggtggacattgataaactgaagctcttcgacctgtttttcctgcctcattttaataaaccctataattatatcaccatggcagccctggcagccagataaaaggcagatgaaaggttgatgaagggcagatggaacgcggatgagaggcagggaaatcccttcttgcattttaggttacttcggggtaaaatgggaaagtatagcatcaggtgtcccaaggacagacatgccctggtgcaggatgtaaggaaggagatttttctatggaagcagtgacaggagcagatttaagctttgtgaacctgggcattaccatacagcacctgccgaacagtatcacggtgtttggtttcaggattgcatattacgggatcatcatcgggctggggatgctggccgggatggccgttgcatttagggacgcaaggcgcaggggccaggatccggatgtctatctggattttgccttgtacggcatcatattttccattatcggcgccagggcttattatgtgatttttgactgggataactataagaataacctgctgcagatatttaacacccggggaggcggactggcaatctacggcggcgtcatcggcgcggtcattacccttatcgtgtttaccagggtcaggaagatgtcctttttctccatggcggacagcggcgtgctggggctgataacgggccagatcatcggccggtgggggaatttctttaactgcgaggcgttcgggggatttaccaacaacctttttgccatgcgcattaagaagagcctggtgaacccgtccatgatctcacagcagctgattgaccatgagattgtggagaatgggattgcctacatccaggtccatcccaccttcctctatgagtcggtatggaacctgtgtgtccttggtttcatgctgtggtacaggaaacacaagaagtttgaaggggaaatgctctggatttatttcctgggttacggccttggccgggtctggattgagggcctgcgcacggaccagctattgattcccggcacaggattcgcggtgtcccagctgctctcggccgccctggtactgatatcggccggaattatcatttataaacaccaaaacctgaaaaaggggaggaaagtgggggatattccaggggggattaagtaaaaaaatcaatatttagtacttgtaagtgggggtatcccacatgtagaggcagttgcgaaaaaccacgcagctgccttgtttttttgaaatttttttataagaaattcgtaaaaactccttgccatttcccaatttctgtactatgatggacatacaagtggtagaaagtggtgcaaagtggtagaggatggttgttatgtggatgaagtgggggtttcggattcccccatgggcatccacgggacatcactgacgtacggcaggtgataagttatgttcatgggtgaatacaatcatacagtagatgcgaagggacgcctgatcgtgccttccaagttcagagagcagttaggcgacgaattcgttgttacgaagggccttgataactgcctttttgtgtatgagaattccgaatggactgcccttgaagagaaactgcgcacactgccccttaccaatgccgccggacgtaagttttcacgtttcctcctggcaggcgctaccacctgtgaagtggacaagcagggaagaatccttcttccggccatccttagggagtttgccggaattgagaaagacgcagtactggtaggtgtgggaagccgtattgaaatctggagcaaggataagtggattgaggcgaacacctttgatgatatggaagagattgcagaacacatggaaggtttgggaatttaatggaggaacaagcatttgtacacaagtccgtacttttatatgaaacagtgggcagcctgaatataaagcccggaggaatctatgtggacggcacgctgggcggaggcggacatgcctatgaggtatgcaagcgtctgggaagcggacggctcattgggattgaccaggacgcggacgccatagaggcggcaggcaggcggctggagcattttaaggataaggttaccattgtaagaagcaattatgagaatatcaggacagtgctgaatgaactggggctattaaaggtggacgggatttacctggatctgggggtttcctcctaccagctggacacggcttccaggggattcacctacagggaggacgcgcctcttgatatgaggatggaccagaggaataccaccacggccgcagacattgtcaatacctacaccgagatggagctgtaccggatcatccgggattatggtgaggacaattttgcgaagaacatagcaaagcacattgtaagggcaaggggggaacaccccattgagacaacaggagagctggcggagataatcaaggcggccattccggccagggtaagggccacgggcggacatccggccaagcgtaccttccaggccataaggattgagtgcaaccatgaactggatgtgctggaacagtccattgataccatgattgaactcttaaacccgggaggacggctcagtatcatcaccttccattcgctggaagaccggattgtgaagaaccggttcaggaccaatgaaaatccctgtatctgcccccatgagtttcctgtatgcgtgtgcggcaggaagagtaaggggaaggtggtttcaaggaaacccatattgccgtccaaagaagaactggaagagaacagccgttcaaagagcgcaaagctgcgcgtgtttgagcggggtgagatgtagataccatgattttaagcgtctaaaatacagacgctaagtgcccaatgcgtacaaaggatgacaagactaagacagaagggaggaataaggccatggctgcaagaagacaggcgtcagcaggacgcacacacacacagacaaaccgcaggccggcacagaggcatgattatgtgtatggttcggcggcaccacagcttaaaccacaggaagctccaagaccggagcggccggcaaggaaaccggcaggcagccaatccgtccggcataaccaccggatacgccgcaatcaggaacgtgcattgtatatggaccttccatatgtgatcatgcttaccattgcgtcagtgtttaccttatacctctgtatcaattacctccatgtgcagtcatccattacggcaagaatgcatcatatcgagaccatggaggcccatttagagaagcttaaggcggagaatgatgccctggaaaccagtatcaacaccagcattgacctgaataagatttatgagattgcaacaaaggagctgggcatggtatacgccaagaagaaccaggtgctgctgtatgataagacagaaagtgagtatgtaagacaatatgaagacatcccggaacactaatggaaacggccgttcccagaacaagggaagtggaaacggccgcgacggacataaccagaaaggcaaatatttttaccccaagtacctgcaggaaaagctggcaatcaccgtattggtgattacgctggctttatttgcattaataatggtgctttacagaatcatcagggacaacaacgagcaatataataagatcgtgctgacccagagacagcaggaatacgagagccgtgtcataccctacaggcggggggatatcgtggacaggaacgggacctatctggctaccagcgagaaggtctataacctgatcattgacccaaggcagatcatgtcggccccggagcgctatctggaacccacggtggatgcccttgtgaccacgtttggctttgacgcaggggaactgcgcgccatgattgaggaaaagaaggattccgcctatctcaggtacagcaaggggcgacagctcagctatgaccagaggactgcgtttgaacagctggcaaaggaaaagaacgatgcctacatcaaagataaggatgaggtggagggcaagaagcgggttaagggaatctggtttgaggatgaatataagcggatttacccctataactcaatggcctgcagcgtgattgggtttaccagcagtgacggaagcgttggcaacggcggtatcgagcagtactataacagcagcctgattggggtgaatggacgcgagtacggttatctggacgagaactccaatctggagggcgtggtgaaatccgcaaccaacggcaagaccgtggtaagcaccattgacgtgaacatccagaacatcgtacagaaatatatcaatgagtggcagacaaccgtgggcagcaaggtcacggctgccattgtcatgaatcccaataacggtgagatactggccatgggcaccagcagtgtgttcgaccttaataaccccagggatgtaagcggatacacccaggaagacctgatggccctgggcaaaaaggaagccgcccatgtatacagaagggaaaacaacggggaaaccatcacggaagaccaggtccttgaccattacagccgcgaggaggtgctgtcctacggccagcaggtcgcatggaaccagatttggaggaacttctgcgtcagcgatacgtatgaaccgggatccccgtccaagatattcacggttgcagccggtttggaggaaggggtaataaagcccaccgacagttttgaatgtaccggtttccttcatgtgggggattgggacattaagtgtacggcataccgcaggggcgggcatgggtggctgaatgtccaggaatcgctgatgcagtcctgtaacgtggccatgatgcgcatcggagccatgataggaagggaacggtttacgaaataccagtccatcttcggctttggcgacaagaccggcatagacctgccgggcgaggcagataccagcagccttgtgcacacggcggatgatatagggcctacggatctggccaccaatgcctttggacagaactataactgtaccatggtacagatggcggctgcattttgctccgtactcaacgggggatcctattatgagcctcatgtggtaaaacagatactgaatgagcagggctccgtggtggagaagaaggaaccggtcctggtgcgggaaaccgtatcccggtccacgtccgacttccttaaggaggccatgttccagaccgttgaggtgggaaccggaaaagcggcccaggtagcggggtacgatgtgggcggcaagacgggaacagcggaaaaacagccgcgttccgccaagaattatctggtatcctttgcaggctttgcgccgattgaggatccccagatatttgtctatgtggtgattgatacgcccaactatcctcccggggaacagcaggcccacagctcctatgcaagtacggttttttcaaagatcatgacagaaacacttccttatttaaatatattcccaaccaatgatctggatgaggatgaatccatccaggagaacctgccatcctccgagggcatcaatgaagccggtacagaggaaagcggcgagggccagggggatttggtggaagaaacagaaaaacaatatgagacagacgagtacgtgccggatgacggcggtgccggaagcggcgtaccggacgcggtcccgaaagacccgtcggggccggaagaagcgcctgcgcagactggccggacccagccagtaaagacgtccgatggcagtaatcaaggccgggacggccaggatgcggccttggacagcacagccgccagcacggaagaaacgcagtaaatggtacagaccatatagaaagattcataaaatgacaccggctccaatatattattaacaatgatggacgctggagacaatcatgaattcaaatcttacaaagcacagaaagaatatagccgtccttgcactgctcattgccattgtcatggcgagtctctcagggcggcttgcttatcttatgatattccgttccgggcattacagcgcaatggcagaggacctgcaccagagggagcgtacgattaaggctgccaggggccgcatcatagatgccaacggggtggttattgctgacaaccacacggtgtgtacgatttccgtcatctacaaccaggtgacggaccgggagcatgtgatccaggtcctttgcagtgagctggggatggatgaggaaccggtgcgtaagcgggtggagaagcgcagttccagggaaatcataaagactaacgtggataaggagatgggcgacaggatccgcgcctaccggctggacggggtaaaagtggacgaagattacaagcgttattatccttacgacagcctggcgtccaaggtgctgggattcaccggaggtgacaaccagggcatcatcggcctggaggtaaagtacgagaagtacctgaagggaatgaacggcaagatccttaccatgtcggatgcaaagggagtggagattgagaatgccgccgaggacaggattgagcctattgcgggcaatgacctgcacatcagcctggatgtcaatatacagaaatacgcggagcagctggcctaccaggtgctggaaaagaaaaatgcaaaaaaggtgtccatcattgtcatgaacccccagaacggcgagctgatggccatggtcaacgtgccggagttcaacctgaacgacccgtttaccctgaaccagaacctgcgcagccagagccttcaggagatggctacccaggcagacggcctgcctgcgtccaagaagcaggagcagctgaaccagatgtggaggaacacctgcatcaatgatacttatgaacctggttccacctttaagatcatcacggccgcggccgggctggaatccggcgtggtaaaacttacggatcagttttcctgccccggattcagggttgtggaggaccggaagatacggtgccataaggtggggggacacggcgcggagacattcctccagggcgccatgaattcctgcaacccagtgttcatcgatgtgggccagaggctgggcgtggatggatattataaatatttcacccagttcggactgaagggaaagacgggaatcgacctgccgggcgaggcggccaccatcatgcacaaaaaagagaacatgggtcttgtggagctggccacggtatcctttggccagtccttccagatcacgccggtccagctgatcacgacggctgcttccattgtcaacggagggaaccgcgtcacgccccatttcggcgtggaggctgtcagcgcggaccagtcctcggtccatgggttcaaatatcccagcaaggggcgtatcctttctgaggagaccagcgccaccatgcggtatgtgctggaacaggtggtatcggaaggaagcggtaaaaaagcaaaactggaaggatataagattgggggaaagacagctacctctgaaaagcttccaagaagccttaaaaaatacatttcgtcctttatcggctttgccccggcggacaatccgcaggtcatggccctgataacaatcgatgaaccggagggcatttattacggcgggaccatcgctgctccggtaataggagatttatttaagaatatacttccttatctgggaattcaggcaacagaggaagaaactgctgtgcacgtttctaatccatagttgattattcccggaaaaagacgtatactaattaccaaataagacatacatatgagattgaggtgcccttatgattcatgaaaccatactagctatcattattgcatttgccatcagcgcactgctatgtcccatcatcatcccttttctgcacaagctgaaattcggccagcaggtaagggatgacggaccgcagacacatctgaagaagcagggaacgcccaccatgggcggactgatcatcctgtgcagcatcatcattacatccatcttttatatccccagttatcccaagatcatcccggtcctgtttgtgaccgtgggattcggcatcatcggtttcctggatgattatatcaagattgtgatgaagcgctccgaaggcctgaagccgatgcagaagttagttggacagtttgttattacaggcatatttgcctggtacctgttaaacagcggggaagtggggacggatatgctcatcccttttaccggcgggtttgacgggggcaagttcctttcactgggaatcctttttatcccggccctgttcttcatcgtgctgggtacggataacggggtgaattttacggacggactggacggactctgcaccagcgtcaccatcctggttgccaccttccttaccattgtggcaatcggcgaggatatgggcatcagtcccatgacgggagccgtggtcggaagccttctgggattccttctgttcaatgtgtatcccgccaaggtgttcatgggggacacgggttccctggcgctgggcggttttgtggcggcgtcggcctatatgatgcgcatgcccctgttcatcccgatcatcggcctgatttaccttgtggaggtattgtctgtaatcattcaggtaacatactttaaacgcaccggaggaaagcgcatatttaagatggcgccaatccatcatcactttgaattgtgcggatggtcggagaccagggtggtggctgtatttgccattgtgactgccatattatgcatggtcgcctatcttggactgtagccgggcgtatttacgcaaggttgtaccagtgttcgtccagtacggtttctggctggatggagcattagacgtgtaccgtattggagatgtaaggaggttaattgacaaatgaaccaaagtcagaaagtattagttgcaggaacaggcttaagcggaaccgcggcggccaggctcgtgcttgacagaggcggggaggtagtgctctatgacggcaatgcctcgttaaaggaagaagagattaaggctaagtttgataaggaggcaaaggtcagcgtggtgcttggcgagatgaagcgctccgaccttctgggggtggagctttgcatcatcagccccggcataccccttgacagtcccttcgtggccgtggtggacgatgccaagatccccatccttggggagatagagctggcgtaccagtgctcccttggaaggctggcagccatcacgggaaccaacggcaagacgacaacaacagccctgacaggggaaatcctcaaggcaaagtatgaggagaccttcgtggtgggcaatatcggcgacccatacacctccaaggtgctggagatgacggaggattccgtcaccgtggcagaggtatccagtttccagctggagaccatcatggatttccgcccggatgtaagcgccatactgaacatcaccccggaccatctgaaccgccacggcaccatggagaactatatacgcatcaaggaatgcatcaccctgaaccagacggaaaaggatgcggtggtgctcaattacgatgacccggtgttaagggagtttggacaggacccggagcttaagccaagggtaatctggttctccagccgggaaaagctggctgacggcttctgcatgagcggggataacattgtatactgccagaaggggcgcgagaccatcctggtgaatgtccgggacatgaagcttctgggccgccataattacgagaatgtaatggccgcggctgccattggtcttgaaatgggcgttgccctggcggatatcggccgggcggtggaaagctttaatccggttgagcacaggattgaattcgtccgtgagaggactggggtcaggtattacaatgactccaagggaaccaacccggatgcagccatacaggcgcttcgggccatgccgggaccgacccttctgattgcgggcggttatgataagaacagcgagtacgatgactgggtggctgagtttgaaggcaaggtgcgctatcttgtccttatcgggcagaccagggataagattgccgagtgtgccaagaagcatggattcacggaaatcatgtatgcggaagatatgcaggaggcggtgcaggtgtgcgcggtttatgcggacatcggggattatgtgctgctcagcccggcctgtgcaagctggggaatgtttaaggattatgaagagcgcgggcgcgtctttaaggagtgcgtcatggcgctgtaggaggtaattgcgtatggcgggaaaggtgcagacggcggcccggcctgaaagacaggcgggccgcccggccgggacacaggacataagagaacagcagatgccaaagaagaaaaagaaggcgaaacatttctatgattacagccttttattctgcatcattttcctgacatcctttggattggtcatgatttacagtgccagctcctattcggcccagctgaactataaggggaacggcgcatacttcatggaacgtcaggccatgattgcggcagccgggtttgtgggcatgctcatcatttccaagatagactaccatatctttgcccggttttccgtcgcagcctatctgatgtcttacatactcatgatagcggtaagctttgtgggcaaggaggtaaacggcaagaagcgctggcttccgctgggacccttcagcttccagcccacggagttcgtcaagattgccctaatcgtgcttctggcggccatgattaccaccatgggtatgaaaatcaacaaatggaagaacatgggctatatcgtagccctgacccttcccattgcaggcctggttgccatgaacaacctgagctccggcatcattgtctgcggtattgcctttgtcatgctctttgtggcatgtaaggtcaaatggccctttttcaccatcggtgcgctgggccttggtaccctggcctttgccggtcccatcggtaagttcctgatgaccatcaagcttcttcagccatatcagttccgccggattgaggcgtggctgaatcctgagtcagaccccacggacaaggggttccaggtgcttcaggggctgtatgccattggctccggcggcctggtgggacaggggctgggggagagcatccagaagcttggcttcctccccgagtcacagaatgatatgatatttgccatcatatgcgaggaactggggctgttcggggcggtatccatcatcctgatattcctgttcatgatatacaggttcatgctcattgccaataatgcccccgacctctttggagcgcttttagtggtcggtgtcatgggacacattgcaatccaggtcatcctgaacattgcggttgtcaccaataccattcccaatacaggaatcacactgccctttatcagttacgggggcacgtcggtcctgttcctgctcatggagatggggattgtcctgagcgtgtccaatcagattaaattggaaaagtgacgcacaagcgggcgcgtcccggcatatgctttaagtagatcgtgttttctgcggaaggcatatataccaggaggtgcccctattgtctgttattcaggtttttggtcttactcccttggaaggggagatatccatacaaggttctaaaaatgcagtcctgcccatggcggcagcatcgctgcttcacagaggtatcacggtgctgaccaatgtcccggtcatccgggacgtggcctgtatggtggacatactggagtatctgggagccagatgctgccacaaaggcgactgccttgtcatcgacgcccgtcatatcaccgggaccagtatcccggaaaagtatgtgacggccatgcgttcctccatcgtggtactcagcgcgctgctgggacggatgggcgaaggcaggagctgttatccgggcggatgcctcatcggcgcgcgccccatcgacctgcatctgatggccctggaagccctgggagccgagataaaggaacatgacgggctgattgaagccaggtgcaggaataaagaagggcttaggggaacggaaatccatctgccatatccaagcgtgggcgcaacggaacaggccatcctggcctccgtgctggcaaaggaggttacggtcatccatggagctgcaaaggagccggaaatcagccagctgtgccgtttccttaataatatgggggcggtcatctgcggcatgggcacggaccatgtgatgatacagggagtggaggagctccatgacagcagcttccgcgtcgaaggggaccggatcgtggcaggaacctatgcagcggcagtcatggccgccacgggaagcattaccctgaaagaggtgagggcagcggaactggagcttccattggagctgcttaagcgttcaggcgcatcggtccggaaggacagctgctgcaggcagatccgcattgagatgaaaaagcgtccccagcccctggatataaggactggtccatatcctgaattccccacggaccttcagtcaccctatatggccttcctggcatcgggccagggaaccagcaccattgtggagcaggtgtttgagggaaggtttgccactgcaaaagccctgggacagatgggggccgtggtggagacagaggggcagcgggccgtgataaagggcagctatcctttaaagggtgcagacgtatatgcctctgatttaagaggcggggcagccctggcagtggcggccctagcagcagagggggaaacccttattaatgactgccggcatattgagcgggggtatgaggatatatgccgggatatggcggctcttggcgctgatatccggtggctggataaataaattcataaccaggtgaggtactgcatgaggaatttttggagaaaacatcacacgggagcgggaattgccgtgacaatcatactgcttgcggcaatcctgcttctgtctgtgcacatacagaatgtctcggtcacgggaagcagccggtataacgcggaacagatggaggaattcctgttttccggcagatgggggaagaactcggcttacgcatattttgcggacaggttccgcccgcaccgccagattcctttcgtggaggattataaggtggtgttccacggcccctttgacgtggaggtcatcatatatgaaaagagcattgtgggatacgtttcgtatatgagcagctacatgtattttgacaaggacggaatcgtggtggagagttccagcagccagctggagggggtgccatgggttacggggcttaattttggacagattgtactccacaaggcccttccggtggaggataagaatattttcgaggaaatcctcaacctgacccagcagctgtcctcctatgagattgcagtggacaggatacagtatgatgcccgtggacaggcttcccttttcatcggccagatggaggttaccctgggaagcaatacggatattgacggcaagatttccacactcagcgacatcctcacggcccagccccagcttacccagataagcgggaccatgcggctggaaaattattcagaggcggacagcagggcaggaattacctttaaaagaaagtgatgttgtgtttataaaaatattacggaaatgtgaaaaaagctattgatattttttgtaaaatcaaatatagtattagttagaccagaaatcaaagagaaattgatatgataatagaagtacaggcatggcttaaagtggcagtatgggaataaaaggaggatatgaatcttgttagagattaagataaatgagtcggacaacgccgccaggatcatagtagtaggagtgggtggcgcaggcaacaacgcagtgaaccgtatgattgatgagaacattgcaggggtagagtttattggtgtgaataccgataagcaggcccttcagttttgtaaggcgcctactgccatgcagattggcgagaagctgaccaagggattaggcgcaggtgccagacctgacatcggcgagaaggcggctgaggaaagctcagaagagatttcacaggcccttaagggtgcggacatggtgttcgtgacctgcggcatgggaggcggtaccggtacgggcgcggctcctgtggttgccaagattgcaaaggatatgggtatccttacggtaggcgttgttaccaaaccgttccgttttgaagctaagacgcgtatgagcaatgctcttgaaggtatcgagaatctgaagaacagtgtcgataccttaattgtgattcccaacgacaggctgcttgagattgtggacaggcgtaccaccatgccggatgcccttaagaaggcagacgaagtgcttcagcaggcagtacagggaattaccgacctgattaacgttcccggcttaatcaacctggattttgccgatgtacagaccgtcatgattgacaagggtatcgcccacatcggtatcggtaaggccaagggagacgacaaggccatcgaggctgttaagcaggctgtgtccagtcctctgttagaaaccaccattgaaggtgcaagccatgtcatcatcaatatatccggcgatatcagcctgattgaagccaatgaggctgcaagctatgtccaggagctgtcaggggatgaggccaacatcatctttggcgccatgtatgatgagaatgcccaggatgaggcgaccattaccgtgattgcaaccggtctggacgagcacggcgccaatgcgtccgtgtccaatgccatgaagggctttaccagcttcaagggcaagacaagcccggcggcttccgttgcccaggttcctcacgcagcagcgcctgaggctgcagcaaccgcctccacaccatacaacagaccggtccagggatatacaccaagctacaatccagctggttccgcaagccagggcggatataccgcgcctaaatataacccaaaccaggggtattctgccggtaatacacagggccagggccagaatccgaatccggcacccacacattcctttaggccggcggccaataaggagatgcagattaatataccggatttcctgaagaataagagataatagagaatgattgtgtacaggggcatgtagggatacatgcccttttttcagttgtcataaaaagcttgtaaaccacataaaaaccttataaacaaaagaatccgggcatggttccatcacagggagcaggctgtcattacactgacagcctgctccctgccgatttttgtcgataaattttcccctcttcctctgttctttcgacaccattcgtacttcagaatagctataatggctttcagaaagtttttcaaggaggtgaggccggactgagtggtttatacagtatacatagacgtggtatttgcggtcaataccatcatggacatggtggtgctggccatattgaacagggtgttgtcatacaggactaccaagagcaggctgtttgcaggcgctgtaatcggcgggatatggtcctgtgtggtgagtgtggttcccggtcttcctcccgcagtggagatactgggaacctacgtggcagtgagcagtcttatggcggtggctgcctatcatctcaaaagttttagggaagtagttaaatccgtggcaggcatttatcttgtatccgtggtgcttgggggtgtgatgcttgtgctgtatgagcatacacgggccggatattatgcatggaggatcatggaggcgggaagggatacaggaatcccggtcatggcctggattttgatgatgataggggctgcactggcctgctatggcttttcaggaggtataaaggggcttatctgttccatggcccggagaaaagacctttgcagggtcatattaaaatacggggaaagagaagaaacagttactggattaattgacacaggcaaccgcctgagggaaccagccagcggacagccggtacacgttgccacagccgggctcatgacccggctgtgtccggcggtaaagggtgtggtatatgtgccgtaccagtccgtgggaaccagccatggagtacttccggctgtgttcattgaccggatggaggtggaacaggagggaagggcatattgcctggaaaaacctttggtggccatcacgaaacagagtttgtctccctcaggagagtatcagatattgatacagaaaaccgatgaaggaacctaaataacacgcagcttacaacgtacaggaggacatttccatgattataaaagtatccataccaaaccgctttcagttaaagaccgtgcccagcttcaggaccgtcctgatgcccaagcagggcgaggtccactatatcggaggcgccgatatactccctcctcctcttgaatcagaggaagagagcaggatgatagggcttctgggaggagaagacgacaaaggcgccaggtcaaccctgattgagcacaacctgaggctggtggtttacatagcaaagaaatttgataataccagcgtgggcgtggaggacctgatatccatcggtaccattggccttatcaaggcaatcaatacctttaagccggataagaacatcaagctggccacctacgcatccaggtgtattgaaaacgagatactcatgtatctgagaaggaataacaagacacggctggaggtatcaatcgatgaaccgttgaatgtggattgggatggaaatgaacttctgctttcggatattcttgggacggatgaggacgtgatataccatgatattgaggatgagatagagaaaaacctgctgaacaatgcaatcagccggctgaacccgcgggagcgcaagattgtggaactcaggtatggccttaccaatgaggacggggaggagatgacgcagaaggaagtggctgatttgctgggaatttcccaatcctacatttccagactggaaaagaaaatcatgaaacgtcttaaaaaagaaattgtaagatttgaatagggtggaaaagtcagccgcggcgctggctttttcttttgcctttttcactgattttatgaccgggtacttgccatggggaggaaaatggactaaattatagatatagaaatatctgaccggcattgcagtgcgctttgggacatcagggtttggaagtcagataggggcaggggggaaggtaaatgtcaggagatatggaacagacagtggaggccgcagtatcttaccgtctggataacagggaacagaaggagtttaaccaatggttcagccggtcgttcctcaaaaggaaaaaggtgcgtactgccaggccggatgtgtcgaacctgcaggaggatacaaaaatccggatggaacccgggtgtattcatatatggtcaggacaaaaggaactgacacttttgtattccgccttgacggagctggaagagacagggacattgattatattctttgcccagaaggaattctgggcaatacccaaacgcgtatttggggatgaggttggcgcagggaggtggtttgggcagttaaaggcagcctgtggccaggggatatctgaccggacggattttgatgtaataagggagcggtgcaccaggaatggaagctgctgcttttattataccaggaccgtggaccaggttttggaagcatacgtggaccttggcaggaaagaaaaggatttgcagaacctgaggaacctggcagtatttccctaccgctatacaggtgtccaggcccttaccctggaaccggacgggatccatgaatatggggagcgctccatggcaaggcatctgtacggggatttggaatccgtggtttatacccgggacttcctgtatctgataaagggggacggggaagaaatcatactgcctgtggaatgtctggacgctctggaggaagcagggcaggagcggacggaaggctggaaggaagcagggccggagtggccggaaggccggaaggaagcggatcaggagctgctttggcgtatcaatcagttcctggcggcatgtaatggacggcgtccgtctggccttccaaaactgcatcctgaaaagcttgacacaccagaggcacaggcgcggtccaggcagcgcgtacggatgcagtccaagcagaatacggataaactgattgtgatgaacccttacagaaagcacaggaaatccggcgcgggcaggttttcaaaacatggaaaaggagaacaatccggccgtcgttggtggaaacaacagaaaaagcggaataaacaaaaggggttcagggggattggcaatccggtcagcggatacatactgattggaacggcggccctcatcacactggccattgcaatctggggacggagcatggcggtgagtctcagggctggcggtcatctggattatttctataaccccggagtatttttaagtggtgctgagtatgccgatatgatagcggaagtgtctgctgaagcagagcgtatgcgggcggaaatcctgcagatagatgggaaggacgcggacagcggtgggatggatgattcctggaaggaacagtatatggtgactgtgccggatgatacggtctttgaccaggtgggcagggatggaacctatgtgtcctccaaacagtattttaccatccagcttccgccgggagattgggaagaccgcagcctgtcaagtgatgatgaccgtctggcttcctcctggggacaggtcatggtcagcggttaccgcaccgagggcaggcctcataagatggcgggaacaggaatcccaaagacaaaggatgaatatgtgaagcagatgaaagccaatataacaggcagcggaaatctgtttaagcgtgaggtgcccataccccaggtggaaggatatgcataccaggaaaaggatggctgtatccttatcaggaaggaaatccgcagtacggagggcgatgggggctatagcctggatttaagcctgatggcccctgagtattcctacacggtaaatatctggctggaagaggagacgcaggaaaatatcgaaaaagccaggacggccctggataccttccgtctcctggacatttccacgggaatctgtaagcagatggaggatgaggtgttccacggttattatggaaggaacacggtcatgaccagctgtctggtacttatggaagaggacatggaggaggatgatatcagggaatgcctggacaaggtaaaggagatagataaggggcttttcgggtcaagggagggacaggccctggctgtccggagtgaaaacagcagatggctgggaatcgactgtcccagcctgcagcaaaactgttttgaaccaaatgcaaggaaggtgtcagaaatctttcaggcggatgtgatcctgtatgatgaatttgacggggacctgctcatggtggcttattgcagtaaggaccagaaggactcctgccagagggccacgtcgtttagtaaaggaatgctggagcaggagttccagtgctatggcgaggaacagaaattcccggagggactgctgcaatatatggacctgaccagggaagaggcttctgccatatgggaggggatggatgtggtattccagatagagaaatgggaggcgctgaccagtcatatgaccaggatgccgataccacaggagttcgtcggtatgtgggatattgctgtgtttggggatggttttgaggtgatacggcaatagcggtgaaagatgtggtatgcaaagatgtggtatgcaaagatgtgtatgcaaaggtatgtatggaaagacatgtatgcaaagatatgtattggaagatatatggaaagaaaggggcatgtgtgatggaaaagcaaagaaacggattatcaaaagcggcgggtggaaaacggaccacggaggatggaaaatggattatgacgggtggaaaacggaccaccgccgtagtgaagcgtaccgcggcgtttgcggtggcaattgtattggcagccgcgccggttacttcctatgggtttcagatgaagggggagtactatgaaatcagctgccaggaagccaatgcgttcatgtttgacggcaccacggcagaggcaggaaccacaggacagctggtgctgtccaagctggaaagcagctgggcgtctgaaagttccataaggaccacggatataagcgtcataaccgcgaaagtggtaccgggagataacgggcttaatgtaatcgagtacacggccaaatcaccgggaacggcccagctcattgtggtggttgagagcggggcagcggtgaatatggggaatttttatgtgacagctgcttctggcggacaaggtacggacattggctggattcaggagaatggccaatggaaatataaaatgggcgatggtacctataaggacaatggatggtttgcggataacggcaaatggtattacctgggaccggatgggaccatgtatgccagccaatggcttcaggatggggaatggtggtattacctgggggcggacggcgccatgcttaaggatacagtgacgccggacggataccaggtgaatgattatggggtctgggaaccgtgaggccgggaaggattggggtatccaggcggacgatatcagggcctgtttgaaaattcattcccgccatctgccctaaggaatccaccagaggtaccaccttaggactaagcacgccccactttgcggcatatttggataaaaagacaaaaaacacccgcaggacatggattgctttgaatcccctgtccgcgggtgtcgctgcgttaccgcatctgtatcatattatccttaatcttaaatgtgccgaagctgcggatgaagctggatatacggctgaatccatactgcttgacatcgaaggacgggaatgcctttttaagctcgtcatggacaatgctcaggttgtccacatgtcccttattctcccgtatcatacggatgatttccttttcaatctcagccttggagatgctggcgcttttctcctgaacaaagtaaccgccgtggagtttcaccacctggaaatcattgttgtccaagctttccaggaaggtggaaagcttggaataaccgtagttgcgcacgtcaaaatccgagaaacgcttggtcaggaaattgcctacgcgggccaggatgatgggctggttctggctgttattctctatcagcagcttggtgatggctttctgtatctcatcgatacttgtaatggtcttctggttctcaatcacggtggcctcaggcgcatcatcggaagagatgatttccagaagcttgaaggtgtcacaggcagccctgaacggcttgggggtcttctgttcgccgattcccattacaaacatcccggcctccctgaggcgctgggcaagcttggtaaagtccgagtcactggataccaggcagaagccgtccacattgccggaatagaggatgtccatggcatcgatgatcatggctgaatccgtggcattctttcccgtggtatagctgtactgctggatgggattcacggaccagtccagtaaaacgttcttccagctgcgtttctcattgtccgtccagtccccgtatattcgcttgtaggtggcgattccctggtctgagacctcgtccaggatatacttgatatacttaggtgatacgttgtccgcatcaattaatactgcaaatcttctttcactctgctccatagatatgttcactttcttatttatttcttaacatatccagtttaacacatcacgggaggggcttcaaggagaagtgagcgacaaacgtatatattttgtacatgctcagctcaaataggtcttcatgctctttaacgcgtttttttccaggcggctgacctgggcttggctgatgtggatttcctcggccacctcagtctgggtctttccttcgaaaaaacgcatatcgatgatatggcgttcccgctccggcaggcgtttcatggcttccaccaatgacaggtcctccacccagttttcctccaggtttttcttgtcactgatctgatccattacataaagcgggtccccgccgtccgtgtacacaggctcgtagaggctgacgggtgtctgtatggcatccaatgcataggtgatatcttctttggatacaccgatttcctgggctatttccacgagggtgggttccttggaattgaccctggtcagctgctcccttgcgtagagggctttataggccgtgtcccttaaggaacggcttacgcggatggagttgttgtcacgcagatacctgcggacctcgcccagtatcattgggactgcataagtagaaaacttgacattctgggtgatatcaaaattgtcaatggctttgataaggccgatgcagccaatctgaaacaggtcgtctatgttctcctggctgtttgaaaaacgctgtatcacgctgagtaccaggcgcaggttccctttgatgtactgctccctggcatctttatccccgttcagtatcctcttgaatagttcctctttttcttcattactcagtaaaggcagcttggcggtattgactccgcaaatctcaactttgtagcccgacataatccttacctccgttatattgccatacatcctgacataaaaaaatggcaggactgcactggatgaatctgctataacgaaatgatgtactgattcggatggttttatacgatttgggggcagaaaaagatttccattttttgtattttgagattttaaaactattattgctgatttcctcgttgaatttatatccaatcagaatacagatggtcatatattcctatttagggggataaagaggtatatggtagatactgtgaatacagggagggaactgagagatatccctccttccgcggtccacaaaagagagggacttgatgtttgaaatcaagtccctctctttttgactggtagtatatatcttataacttcatttaaatctgctgttccctgtccttattgcagcatgtcagataaatcttgatgcattctggtgtggaattcatggcatatcttgccatatccctgggtaggaccgtcataccgtcacaggcccatttgacatacatattagaagcaccatgtgcattaaaagccagggcatacagacattcatctgtaagcacatgttctccaaaatggttggatatatagtctttatagtaattataggtctggttgtatattgcttccagaagacagttctggccttccagatggcatgcctgagtaaaaaaaggctgatttagtttggcattttcatagatgcttaaaagataggtgtaaaaaccactggattcaattattttcttttcgcctctcagtgttctgaggaaaatccagaatatcaaatcatttttatctaaaaaatggttgtagaatgtctggcgccctgtgccaacatgtttgacaatgtcggtaacggttactttgcttaatggtttttcattactcaattcaatgattgcatcagcaaataatttttttacatcaatagccataaaaatcccctttgtgtaagttgttattgtacccataaagataaaataatcattcggaatcgtcatgaaattcaagattagtaaatcagaataaacgggttttaagatactcttacccaccatgataatctatatttagaaaatgtcaatatgtgcattattacatattagtaaaggtgattttgggtgcagggagggggattaaacgacaataaattcacaataatgataaaaatattaatattttagtacatgaaaatagatttccagtccaaagtacagtcaaaatagaatgtccatatttagacaaatatataaaaaagtccatatttgtacactattaactgattataaatttaaataatgctatttttagtatataattcaattaataaaaaattaacaaggcgagatatacgaaattataatggaataatggataaaaatatagtttttcagtaaaacaggagggagataatggggaagctagtagttgaaattgacaaaagacaggtagaaaagtaccgaaaacagggactatggggggatgcaaccttactggactactggttattgtcagttaaatcatatgctgacaaaaccatggtcgtagatgaccaggattcgtcctatacataccgtgaactggacagggcgtctgattgtctggccgtctatttaaaggaagaatgtaatctggaagaaggggatattgtctctgtccagctgcctaactgggctgagttcaccctgatcctgattgcctgcctgaaaattggtgttgtggtcaatccattattgacaggattcagggaaagcgaactgattcaccggttatcaaaatgttctgccaaagtcatgtttgttccgggggaattcagaaattgcaatcatgtggtgctggctgaaaaagttgctgaaagtgttcccagcctgcagaagattgtgattgtggacaaacattctccttacaatggacaaggtaagggatgggaccatctttcagatattctggagaacggaggtctggttaaggaatactgtcagggcaaagcagaggatgtggcaattgtattatttacatcaggtacggagagtgttggaaagggtgtcatgctgacccacaataatctcattgccaatatgaagggctatatttccatgactgatctgcacagctttgattccatgataatgcctgttccactggctcatgccacagggttgatgtacggagtcatagttccgttcatcaacggaatgaccagtgttcttttggaacggtatacagtggaccggtgtcttgatatgattcagcaggaaaagtgcactgtgatagaagggccaacagtaattgcttatgatgtaatacgccggattgaagagcgccctgaagtagatatctcatcactcaggttcttttactgcggtggagcgcctgtgccgcgtaccctggtggaaaaagctttaaaaaagggaatcaaggtattgggggtttacggctccacagagagcgctccccactgcgttgtatccccttggttccctactgaaaaggtactgacaacggatggacttcccgttcctggtacagaagtaaaggtggtggatgaacggggagatacggtaggaccttggattgagggggaggaattatcaagaggccccggcgttttcatgggatatattgatgagccggaaatgacgaaaacagcaattgataaagatggatggtaccatagcggggatttatgcatcatggatgatgacggtttcatacgtatcacagggcggaagaagaacatcatcataagaggtggggagaatatcagcagtgtggaaatagaaggtatccttatgcttcatgagaatatcattgaggcagctgtggtgtcttatcctgatgaacgcatgggagaaaaggcctgtgcgtacctggtattgaaggataagggtcagaccatgagtctggcagaggttcaggcccatatggaaaagaatggaacagcaaagtacaaatggccggagaggatagagctgattgaccatctgcccagaacagaaaccggaaaggtacagaagttcaaacttagggaggatatcagacggaaaataaaatgtcaagcaaaggggatggaggtgaaatgattccggaaaggcagaattatacaacagcctgtatggtaagccgctgcccggcaatgaacaatgaccgtccggtatttttccggtgcggaatctgtggcagcatcagtatagtgtatggggattgttctcttactgaattcaagtgtgggtgtaatggaacacgccagcgcttggagacgcctggttcagaagagaaggatggaatccatgcgctgtcctatgtattttttgggggagcggaacataatgcagtgcagatttcagttggggacggaaaccatcctatgacagaggaacatcgtatccaatggatttatctgcttacctatgaaggcgggcagctaaaatacctggatacatccttaaaggcgcggactacgtttgccatggctggaatggatgcctattcatactgtaatcgccatatatgccatatgggacataaacactgccagtttcagtgcaagagaggctgggaaatttacgcatactgtagcctgcatggtctaagccgtctgatattatgaccatgcggggttaacaggagaaggagggtgagaatccatgaagaaactttacaccccgggtacgataggaacccttgagattaaaaacaggatagttatggctcctatggtagacggatatagtgaaaagggggcgcctactgaacgaagcctggaatattaccgggtcagggcggccgggggagtaggtcttattattgttggtaatatacatgtagatcctgcccataggcatgtgatgcctggatttaatttatatgaggatagttttacagaaaaacttcgtcccctagtgaatgtaatccacgagggtggggcaaaagcctttgcccagctgattcatcagggaagatatgcaaaaacccgtgattacatagacggggtacaggcagtagcgccttctgccattttcacgcgcatgacgggagaaacacccagggagctcactgtcggggaaatcctgtacttggagaatgcctttgcagaggctgccagacgggcagtagaggcagggtttgatggtatagagatatgtgccaattcaggatatctctttggacaattcctatcacccctgactaatatacgggcagaccagtatggggggaatctggagaaccgtacacgttttcttgcagaaaccattgcagatgtacgggaaaaggtgggtaaggatgttcctgttactgtacgtattgggggcagtgactttgttgcaggaagcaacaccaacaaagaggcatgtcagatatcagtcatgatggaacaggcgggagtggatgcaatcagtgttacaggaggatggcatgaaagcggtgtgccgcaggtgaccatggatttgcctcatggtatatacagctatctgggaaggaacatacgcaggtatgtcaatgttccggtcatgatgagtaaccgtatggatgtgaagacggcagaagagttgattgaacggaaagatgtggattttgcagtatttggccggcctatgctggcagacccggaatttccgcgcaaggcttcggaggggagactggaagatatcaggccctgcctgggatgcaatcagggatgtctggaccactccatgagcggaaaaagtattcagtgcctatgtaatgcggagtgtggccgggaaagcagtctgatggacgacgaaggacggcttcccactgagaaaaaagcgggacatgtaaagaaaatccttgtcattggagctggtgtggcgggaatggagttttccagaacagcagctatgaggggacactccgtggttatatgggaaaaggaaacctgttgcggagggcagttaaacctggctgcggctcctccggcccggcatgatttcatatatctgacagaatacctaaggacagcctgtataaaagcaggcgtggaattctgctttgggaaacaggcagatgctcagtccattttaaaagaggtaaagcagaatcactttgatcatgtggtaatagccacgggagcggcgcctcaagttcccaggattccttcagatgcaggagcttatgttgtgcaggcatgggacgtgcttaaggggaatgtacagaccggtacagaggtagtggtcgttggcggcggggcagtggggattgagactgccatccttttaggtgaagatggaaccttgactcccgaggctcttaggtttcttactttatatcaggcagaatcacaggaaaccttgtgtgggatgcttaacagcggcagcaggaacataactattgtggagatgcttgataaagccggaaaggatataggaaagactacccgatggatcatgatggaccgtctgagaaaactgggaatcagaatctataccagtacatgtctggaagagataaaaaaagacagggtagtggtgaatggtcctgatggaataagggaacttcctgctgatactgtagttctggccattggttcaaaatcagagagcggcctgtatgggcagataaaaaatgaatttcatgaggtttctgttatcggtgatgccgttacgcccagaaaagccatggatgctgtcagggaggcgtacgacttggggatttcaattggctaaaattgaatcctccggcagatgtgttacagaacggaaccctataataaaaggaatgcataattatgacagaaaatgttttttccggtttgacaatacttgatcatacgcgctatctgttgggcggttatgcgactcaggtttttgcagaccttggtgcagaggttattaaaattgaagaaatatcaaaaggagatttatgccgggatgatatcccaaggataaacggagtcagtcattacttctcagcgctgaaccggaataaaaagagcctttcccttaatctgaaagaccaggggggaagggaagcctatatcaaattattagagagggcggatgtggtcattgaaaatttccggcccggagtcatgaagcgtctggaacttgattatagcattgaaaaaaaaatcaaacccgatatcatacactgttcattgactggttttgggcaggatgaccccagaagcttaaaagcttttcatgatataaattttcaggctctcagcggatatctatccctgaacggagggaagacaagtcctattcactttgtggatatttccacagccatggtagcggtgcaaagtattatggcggccctgctacagcgtaaggagaccggtcagggagcgttttgcgacatcaggatgtttgattcctttgtgtggtggaattccatcctggatgccaggtatcagttttctggaaataagttgacagaggacactttggacttcccggtcctggcatacaatgtgtatgaaacagcagaccatggaagcatatccgtgggtatgctggaagataaattctggaatcagtttctttcgctgaacggtcttgatgaattgaaaccttttaagttaagccgtcctaaagaagccccaaaagcatttgatacattgaagaaactttttaaaagccggaccatggaccagtggaagaaatggcttaaggataaagacatctgcgccatgtgggtcatggacaaaaaagaggcagtaaactacataatatcaaaggatacaggcctgatggaatattgtgattttccatgtacgggggagactcttcagactaggataccacagcttataagttccatccctgtttccctgaaaactgcaataccagccccaaaactaggtgagcacaatcacaagatccttaaaagcttggggtactcggaagtggaaataataaaaatgtctgaaacaggagcttgtggaacactctggccctgtatatcagcagataaaaaggaggaagaaaaagaatgttaaacaatcagagaatcagtgagaaagaactctatgacctgagaatgaaaattcgaaatgtggttgaaaacgatttggaagccctttcggcagaaatggaaaaaagtaacgtttatccgcctgagatgtgggaaattggaaagaaaaatgatatgttccgcctttctcttccaacggagtacggcggtatgggattatgtctggaacaatattttacagttcttgaagaaattggaagaggaaatcaggctatccgaatgtttttccatgtggccaatggacttagctgggaaatcatggcagagcatggcagggaagagatgaagcaggagtatcttcctaagatgggaaccggagattattttgtagcatttgccctgactgagcctgactgtggttctggcgttgatatccgcagcactgctgtgaaaaagggggataagtgggttctcaatggacgtaagacgttgatttcctttacagatatctgtgatgcatactatatcattgctgtatcagatgaagctaaacgcaaaaaaggcggacatactgccttttatgtcccggcgggaactcctggaatgaggattgaaaatatgcctcatatgatgggatgcagggggaccgggcatggggatgtggtaatggaagacatggagattcctgatgaataccgcctggggaaagaaggcgaagggctgacagtattccttcatgcacttgccatatcacgcgcttccataggtgtctgccttctgggactttcacagcgtatgttggaattagccattgccagggcaaaggacagggtgacatttggaaaatcgttgattcagcgtcaggcagtccagcagatgctggcagatatggccacacaggttcacgcactgcgtctgctggtacgtgactgtgcccagaaagcggacaggggagaggacattgagatgatttcctccatgctcaagcttcacgggattgatacggtccgcactgtatcggatggatgtcttgagatttttggtggtattggatattttgaagataatccatatggtccggtggaacgcctttaccgcgacgcccgcgccatgtggtttgaggaaggtccacggacagtacagcgccttacattggtccgtagggtgattgatgcggatggggagattaggacatccaattattgctgacgaaattaagctgacaaagagaggtatccagactatgaaaccattagaaggcataaaagtgattgaacttgcagaatatgttgctgttccgggagccccccggcttctggcggactggggggcaaccgtatacaagattgagaggccccagggagatcccagcagacacttgggtccgtctttcaaaatgattgattttatgaaagaggattataatcattgcgtggatatgatggtaggaggaaaccgccagtatatctgcctggatttgaaaaaaccggatgggatggaggctcttcacaagctgttagagacagcggatgtgttcgccaccagctggcgtcaaaaggcactggacaagctgcacctggattatgattccttaaaagaaaaatatcccgggcttatctatgcccaggttacgggctatggagactatggaccggaaaaagacagtccgggctatgataccatatgctatgcggcaaggggcggatggttccgctccctgccccaggaaggcgatgctcctatgaactggcctaatgcccttggtgaccttccgacatcagtggccctggctgcgggaatctgcggagcgttggttaaaaaagcaaaaacaggactgggtgaccgtgtattcatcagcttgtaccacacggcgctgtatttcctgaccgtgggtattgtgaccagcacatatgacaaccactatcccagttccagaaagaatcctccaagcccattgaataacacctatcctaccagggatggaggatggatttatctttgtatgccggtatatgatgccgaatttaacaaatgtatggatttgattgggcggaatgacctgatagattctcctgaatacagcaattatagtaaggtgctggcagagggtcgtgttgcggaagtggtaaatattattgaagaaggctttatggaaaaggatgcagatgaatgggtacgtattttcaaggaaaaagatatcccggcaggaaaatgttttactgtggatgatatactggaagatcctcaggcctgggaaaatgatttcctcaggaaaatccactatgataatggcgttgacggtattgtaacagatacgccggtacggttccagagcatgggacttccgccgctggagcagtcaaaaccaatcggttatcatacagaagaggtcttaagccagtacggttatactaaagagcagctggatgagatgaaaaaaaacggtgtaatcacagtaaataaacgtaactgtgaatgattaagtgaaaacttgtgaggtgaacggatatgacaatgatttatacggaagaccaactggccatcagggatttggtccgtgactttatggcaaggagagtgaaaccccacctgagagagctggatgataaaggggaatttccacaggatatatacaaagaggcgtttgaaatggggcttcactgccttcagataccggaggagtttgggggggcaggtcttgattatgtgactatggcagtggccttggaagaaatgggaaggtgcgatcctggttttgccattaccatgctcagcacatccatgacccttaaatgtatccttttgggcggcaatgaggaacagaagcaaagggcggctgatatccttattccaggcgcacatggcagtttcagcatgacagagccaaatgcgggttctgatacactcagcctccgtaccacagccaggaaggatggcgatgattacattttaaacggtactaagtgctttgcaaccaatggggcatacagcgatttatatgtgattattgcaactgtggacaggtccctgggatcaaagggaacggttgcatttatggtagaaggaaaaacacctggtctcagtgtgggcaagcatgagaataagatgggacttcgtctttccaatacctgcgatctgttcctggaggatgtgagggtgcctgctgccaacatgcttggttctgtgggggatggtattaagattgccctgggcggtttagatacaggacgtatctataatgcagcggtagcagtgggaattgcccagaatgcattggaagaaagcgtggcttatgcaaaaaccagggagcagtttggtaaacccatcatagaaaaccaggcgattaagatgatgttggcagatatgcagattggcacagaggcaggacggcagctggtattcggtgccatgcgtcttttggatgcaggggtgaagaaagtcagcatggaagcatcctgtgcaaaaactttctgtagcgataacgcggtgaaggtgacaacagacgcggtacagatatttgggggttatggttacagcaaagagtatccggtggagaagatgatgcgcgattcaaagatattccagatatttgaaggaacgaatcagattcagcgtctggtggtgtccagggaactggccaaactttactaagtttctttcttgattaaacaataggagggtttcaatatggcaatgaagagaccatatggtggggagcagccatatataaaagtggggatgtttaaagtacgtattccgtttattcattgtaatcctacatttcctgaggcaattcagggtatgtgtaatggcgtgctgtgttttggggcaatagcaaccgtcatgctatgtacaggagtaagtgaggaggctgcctatggggccgcttttctcagcacctttctctatatcatcaattccctggcaggggatccgactgtctgtggctggattatgccggcagtaccgcttgttgttgcattctgccagggctatccgccggaacagcaggttcaggctatggctgcgctgcagttgatgctggcggcaatcttcctgttcttaggaggaaccggacttgcaaagaaggtaattacctttgttcccccaagcatcaagggcgggattgtcctgggggctgccattgcttcgatttttggcgagtacaaaaccggtggacgtgtggggacctaccccattacaatcatggtttcgaccgtcgcaatgatcttccttctgtacagcccggttttcaaagggtgggttaagaaagggaatcctgtggcaaagatgctggccagcctggggctggtgccggcagtcatacttgccatgattctggcggctatcacaggagagagccccatggagttttccatattcccaatcattacccttcctaattttgctacgatgtttagggaattatcaccattctctgtaggatttccaagtccggccatattgatatccgctattcccactgcatttgccatttatattgttgcatttggggataccctggtactgaaggaaatcgtcagggacggaacagcatccagaaaagatgagtattgcgaactgaatgtaaaccgtgtaagtatcactgctggtttgagaaacctgattctgggctgcatctgtccttttggaccacttgcatctccgctgggagcagcctttaccatctccatgctgcaggggtatgaggaccgtggggaaaaaggattctatagtgtacacggcggcgccatgtcaggtaactatatgccattcattaccatgattttcacaccgattgtaagccttgtgcgtccaatcgcacctatctgtatgagcctttgccttgtctcacaaggcttcacctgcaccgccagcggtattggcctgtgccgggaaaaaactgatttggccattgccggggcaattgcggcagttatggttgccagaggcgctgcatggggatttgcagtgggcattgtatgctacatatttattgcatccagggataagcgtaaggacgatctggcatataacagatccgttattgcagctgaggatgaagaagagcgtaaggcgcgggaattaagggaaaaagagcgtaatgcagccgcataggcaggagtgggctgtcactatataatattgaaaatgagggatgaatcatgaatattttagtatgtatcaagcaggtgccggatactacggaaataaaaatagacccggttaccaatacattgattcgggacggtgttcccagtatcgttaatccatatgacggatatgcactggaagcagccgcgcgcatcaaggacgcggatccggatacaaagatagtagttgtgtccatgggccctaatcaggcaataaaggcattaaaggaatgtcttgcaattgcagcggataaggcatatcttgtatcggaccgggcgtttggcggctctgatacgctggctaccagttatattctgtcgaataccattaaaaagcttgaagaaacagagggaagatttgacgcggttttctgtggcaagcaggctatcgatggagacacggcccaggttggacctgagattgcagagcatttgggactgccgcaggtaacctatgcactggaagcagaaacagatggggattccttccgggtcctgaaagaaggggcggattacaatatgatgataggaattgccatgccctgccttattacgtttacgaaaccaggctttgaaccacgctttccttccattaaaaggaagatggcggccaaccgcgccgttattcctgtattgactgcggctgatctgccggatattgatcttacgcgtgcagggcttaaaggttcgcctaccaaggtaaagaaatccttctgcccggagcagaaaaagggcggaattatcattatggaggacagtgaacatgcatcggcagcaaagctggttaagatgcttagcgctgcctgcctgatataagaaggaggggagaccgcagatggacgcaaagacaaaggatttatgggtatttattgaaacaaaggaggacggaacccctagaaaggtgggactggaactgttgaatccgggccgtgacctggcttacaagcagggagggaagctggtagctgtcgtaatcggataccatacagatgagtcagttaaggcagcaggggaatatggagcagatgaaatcattgttgtggatgcagaggagtttaaagaatattccactgatgcatatacagcagccctgacatttctcatagagaaatatggtcctactaccatgcttattggtgcaacacccacgggccgtgacctgggaccaaggctttcatgccggttaaagacaggcttgactgctgactgcaccagactggatgtggacatggaaaccggcaatatggcatggacacgccctgcttttggcggaaacctgatggcaaccattctctgtccggattgcaggccgcagttaggtacggtgcgccctggtgtctttaaaaaacctacagctggaatatcaagagcaggcattattaaagaggagtattccttccccaaggaaaaaatacgtacaaaaattctggaagtgattcaggaagcagccagtgagctggttgatttggaaggggcagaaatcattgtgtccggtggacgtggagtagggggaccggatggttttaagctgattggtacccttgcggattcactgggagctactgtgggcgcatccagggccgcagtggatgcgggctggattagccattcccaccaggtgggtcagacaggtaagaccgttgctcctaagatttatattgcctgtggtatatcaggagctatacagcacttagcaggtatgagcggtgctgactgtattattgccattaataaggattcagatgcgcctatatttgggattgcagactatggcataataggtaacctgtttgaggttgtgcctgccatggtggaggaaatcaaaaaggccaaagggtaataaggaaagagtgccgttcatatattataaaaaacatatatgaggtttccatgcagaccataacacaatacacgttgacggaccagatggattaccaggggaccccggtcttgaactgtcagatccgctatccacggtttgacactgcctgcggccaggatgcccaatggcaggtgaatgaattctatcgttccatgtcagaggaaaagggggcgtactgccgcagcagcctgtatcctgaggcggtcagcggattagaatacagccgcgccgggaatttcccctttttcccttatgagtttgatgtgggttataacgtgacctttaatgaggaatgttttgccagcctgtattttgaccagtatgagttcacaggaggcgcacacggctcgaccatacgcacctcccagacctgggattttgaaaccggcaggcagcttacgctgggtgatttttatccggatgacccagactacattaaagaaatccaggaatggattgagtatgagattgctgggaggttaaaggcagggccttccacgtactttgatgattaccccgagctgctgcgaagcacattccaggcagggaatttctatcttacgccggaggggatagtgatttattaccagcaatatgacatagccccttattccagcggcataacggaattcctcctgcccttttcagggacagactcataaaaaggctttagacagggaaacagcgccgggattgaattcctggcgctgtttccctgtctaaagccttttatgacgtactgttacgcatgtatccttctggtatcctacctttctggtatctacccttccggcatcctactgcgcgttcttccggtataatatcaataatcccttcagcagaagcgcatcatccacgatgatcctgtggcggcacaggggagtgatgaacttggccagaccgcctgtggcgataatcgttggctcctcgcccaattccagggccatgcggtccaggatgccgtctatcatgtccacgttgccgtagataatgccggacctcatacagtcaatggtattcttgccgatgacgtggcctggtacctccaggctgatgtagggaagctgggccgtcttgctgctcagggaattaagggataccttgaggccgggaaggatgacgccgccaatataattgcccttcttgtccaccgtgcaaagggtggttgcagtgcccatgtcaatgaccaccagcggaaggggatgctcatggctggcagccaccgcgtccacaatctggtcgcttccaacggtctttgggttgtccatgatgatgttcatgccggtcttcatgccggaacccacaagaaggggagaaatgccggtgacctttgtaacggcgctcatgatggtggaattaaggggagggaccacggatgacaggatggctccctcaatggaaccgatatcaatctggttcatctccaggatgttcttaaagcttactgcgtattccgtatccgtgcggccctggtccgtggtgacacgctctataaaataggtcctttcttcatcaataccaccgattaccgtgttggtattgcccatgtcaatggctaaaatcatgcgggggaactcctttccattggaaaaaatatatgatatactttaccatggattgtatcatagaacaatctgaaaaacaacagtcttggttccaagggaggaagttatgttaaaaggaaaaaccgtacttctcggagtaacaggcagcattgccgcatataaaatagccagccttgccagcatgctggttaagcagggggtgaaggtgcatgtcctcatgacaaggaatgccacgaatttcatcaaccccataacatttgagagccttaccggcaataagtgcctggtggacacctttgaccggaactttgaattcagcgtggagcacgtggcccttgcaaagcaggcggatgtggtcatggtcgcccctgcctcggccaatgtcatcggcaagattgcccacggcattgcggacgatatgctgaccacgaccatcatggcctgcaggtgcaggaagatcattgccccggccatgaataccaacatgtatgagaacccaatcctccaggataacctggacatctgccgcaggtacggcatggaggtcattgccccggcctgcggttatctggcctgcggggatacgggggcaggtaagatgccggagcctgaggtgctgttccagtatattctgagggaggccggataccccaaggaccttgcaggaaagaagatccttgtaaccgccgggccgaccagggaatccattgacccggtgcgtttcattaccaaccattccacaggtaagatgggatatgcaattgcgaaagcggcagcataccgcggcgcggatgtcacgctggtaagcgggccggtggaccttgccccgcccatgttcgtggaggtggtgcaggttaagagcgcccggcagatgtatgaggctgtcacagggcgaagcagcggacaggacataatcataaaggcggcggccgtggcggattaccgtcccgcagccgttggaacggagaagattaaaaagtctgacagcgacctttccattgccctggagcgcacggatgacatccttggctggctgggcagccaccgggaagagggccagttcctgtgcggcttttccatggaaacccagaacatgctggagaattccagggcaaagcttaatcggaagaacatcgatatgattgtggccaacaacctgaaggttaagggcgcgggattcgggacagataccaacgtggtgaccatcattaccagggaccgtgagaaggagcttcccctgatgggcaaggatgaggtggcggatgcgctgctgaccgaaatcatggcctgccgggaaccgggccgtatctgatggttcctggggctggatggagtatgacaaaaagacaggagctgtgtccatgaaacgtaaattccgcttgctggaacatttcaacaatatgaaaataggcaggaaaatcatgtctgcttttgtcctggcttccatcgtgcctatcctgaccattcagtttattggctataatatgaacgccaattccctgaaacgcaagattgacacgctgatggtggacaacctgacccagctttcggaacgggtggatctgaccatggatatatactctaacctggtttatcagatttatgtggatgataagatcatagaaaatgtcaacatccttctggacggcaatggggagggccgggaggtggccttccattccatctacaaccgtctgcagcaggcggaaaagtccgtcaagggcatccgcagcatcagcgtgatctgcgccaacgggcagtctgtcacctatgatgccggcacgggttcttccatcgagaacctgtgggatgattacagggacctgcgggagatagagccttaccaggcagtgcaggggctgcccggcatgttggtgacgcctaccaccagacataagggatatgatggggatgcgtattatttccatatttccaagtgcatgtatgattataataacctggacaggggaaccattgccaccattgtcatgagtgtggatgagggggtgctgcgggacatatgcgcggttgccattgcagaggatgaggctgagtacaacattaatttcattacggataccgatgggttcgtcatatcctaccccaatcccttctataccggaatcaacatgaatccaaggctgacggttcaggaattcgtccaggtcaccggcctgctgaaagggcagaacacagcggtcaacaagtatgtcaaccagaaccgcggatgggtctattataatgtctacaacaaggattacatgatgcgggatatcaggaataaccagatcatgttcatccttatcagcctggcggccatcctgttttccagcatcctcatcagctatatcgtgcgcaggatcggcagctcggtggccctgatcacagacggcattgaccaggtaaaagaaggaaacctgaacgtatccgttgcgctggagagcagggatgagcttggacagattgccagcaatttcaacgacatgacagggaaggtcaggaatctggttgccgaggtatcggaggcaaaggataagcagaaaaatgcggagatccgcgccctggaagcccagattaacccgcatttcctgtataataccctggattccatcaactggatggcaattgaaaaggaagaatacgaaatcagccgcatgctgcgcaacctgggggtcatactgcgctacagcgtgaaccgcagcaaccagatggtcagcgtcacggaggtggctgactggctggagaagtacataagcctccagcagatgcggtttaaccagtccttccggtttgagctgaatgtggcggaggcagccgggaaggtcaggatatataagctattgctgcagccatttgtggaaaacgccattatccatgggtttaaggatacggagaagggcggtgtgctgcgggtggatatattcctgtccgagacaggggagcggcttaacatcatcatagaggacaacgggaaggggatgccccgggacatggcggagtcctttaatgtgcgcgaacaggcagtgaaggatgagggcggaagcattggactgcacaatgcatttgcaaggatggacatgtattatggcagggaagctgtgtggaatgtgaacagcatcgaaggcatggggacggtcgttaccctgacattgcctgtggaaacagatttctgacagaggaaatgcttactgtaaggctgtacgatggaccgggagggtgttatgaggatactgattgtagaagatgaagtgatgataagggagggcctggcaaagcttattaaattccataccgggcacacggtaatcggcgaggcttccaatggacaggagggcttgaacctggcagtcaggttcaaaccggaactggtcatcacggatatccgcatgccggtcatggacggacttcagatgatagaaaagttccatgagatgaacctgaacatccgggctgtgatactaagcggttattctgaatttgagtatgccaggaaggcaatctactacggggtggaggactatctgctaaagcccctggcagccgaggacatcgtggatgtgctggagcgcatcgagaagaagatggaggaggaggaacagaaaaatgcaggcacgcccgggcagtgcataaaggaactggtgtacggcggtcccctgacagaggaggaggaccggcgtatccggtccatctgcggctttggcatgaccagtcattataagctgtatctgggatatacaggggaggcccccattggctatgaggaagagataaaggagaaatgggagcagataaaagaccagctgccttccattaccatgcatgtggcgtctgataaggtgcggcggcagattatatgcttggcggcgcttcaggagggaacggatggggaaggggaccttgtcccgtgcccgctcaggcaggcagtggagcgcaggattgtgcggccgtacaagcagagaagcggacgggctgtctgggcggaggtgtccgcaggcagatgggaggacataccggcagcggccagggatgcggaggccctgttaaaggaagccatgcccgtgacggacggcgggcttctcacaagggagcgcatggaccggatccagtggaaggagttccatttcccggcggatatcagtatggatataaagaacgccctgtgccgcggattgccggaggatgtggggaaatcaggggaactgttcatccggtatatggaggacgggccatacaaggagcaggaaatccgccaggcgtatctgaaggcggtttacctgctgttagacacaatccgggaaatcgacggcacggcctatacgcagatgcagaatgcggaccttctgtccaaatgtacggaagcagtcaccctccgggaaatggagcagagctaccgggatggcctggccctcctgtgcagtccgcggcgcatgaaagaggatatcagcaattacaccatcaagcgggccatcaactacatcagggagcattacaaagaagggatatccctggaggaagtggctggaaggctgggtatcacgccggagtatctgagcaccctgtttaaccgggagatgggggaaaacttttccacgttcctgagaaagttccgtatcagccatgccaagcggctgttaaagggcacggatatgaaggtgtatgaaatcgcggaggaagtaggatatacggatcccaaatattttgccagggtattcaaagaggaactgggcatatcaccgggagattacaggcagcagtgacaggaggaaggatacatgaaggatggtgtgggaaaatggagggccgcggacggattggtaccggccattttagttccggttgtcctggtcctggctgtttcgcttctgcttaacggctgtgggggacggccggaagccggaacagggaatgcggatgccggggcaagggaagtggtcatctggtcctactatgagacaaaacaacaaaaagaaggcctggaccggctggtggaaggttttaacaaccggcagaaggactatgtggcccggtgggagtaccaggggccttcctcggaatttaaaaaactgctttccatcggtgtggcggagggaagcctgccggatgttgtcatcattgataatccggacatgaggaaatatgtggagctgggcattttcgaggatataacacggaccgtggaagcggattatgacctgacggaattttatcccgaggtcatctcatccgtgcggtatgacggcaggtattacggggtgcccttctgctgcaataatgtgggccttgtgtataacaaggacatgttccgggaggcggggatggagccgccggggaactgggagcagttcctccatgcggcagaggtgatgactacaaaagaacggtatggttttgccatgtccgcaatactggaagaacagtcctccttccagctggccccatggctcctgtccacaggtgaggacatggaggacctgggcggggaagggacggtggaggccctttccatgattaaggagatggtggataaggggtatatgcccagggactgcatcaactggtcccaggtggacgtggccagacagtttgcggcggggaaatgcgccatgatggagaatggtccatgggcccttcctctggtggaggaggcaggaatcgattacggggtggtgacactgcctgtggatgagcggagcatcgtggtaaccggaggagagaacttcgggatcatcaaaggaaaaaatgtggatggggccatggcgctgctggcctattattatgaagatgacgtgatgctgcggctcaatgaacagatgtatgccctgcctcctgtgagacggctggccgtaaggcttcaggagtccaatcctgcctaccaggtgtttgcacagcagatggagcactgcatcaccagaagcgcctatctttactggccaaagataacaggggttttatcggaaagcctgtacggggtaatcgtgggtgggacatcgccggaggaagcggcagatgacatccgtgacaggatacaggcatgcatgcaggaatgaattttcaaacacgctttaggtagagaaaattaaagagggtggataattttaaaccgtttttttgccggatttaaaatatgtccaccctctttaatattttcccctaacaaacaacaaggccccctcttataatgaaatcaccaaaagcaatacaatattgagagggaggtttttagaatgaagaaacggttcgtcagtacattattatgcgcagccatggctgcttcactggttacgggatgcggttcggggacggcgtccggcggcggaaacacacaggctgcagcggatacgggcagcaaaaaggaagtggtcatctgggattattttgagacggatgcccagaaggcaatgatgaccaccttactggacggattcaatgcatcccaggatgaattcgtggcaagccatgtgtacgtgccattctctgattatgagaaacagcttactttgggaatcgcgtcaggagagcttcctgacctggtcatcctggatggctgctccatggcgtcctttatctctttgggactgttcggcgacatctcggatgccgatattaaatgggatgaatacatagccggaccaatggaatccaccatggccgacggcaggcattacggcatcccgttcgcaaccaactgtacggccctgttctacaataaggatatgtttgacgcggccgggcttgcatacccggatgagaataccacatgggatgatttccacgagatggcgaaagccctgaccaaggatggggtaaccggttttggcaatgcggccaccaacacggatgagggtacgttccagtgcctgcagtggctctatacggccggagggagctataccgacatcaagggcggcaccgaggcgtatgaactgatgcaggaaatgatttcagacggttcctggaccaaagaggtggtcaactggacgcagtcggatgttaacaacaacttcatcgcaggcaacctggccatgcagcagaacggaccatggcagattcccggcatagcaaaggatgccccggacttaaactacggcgtgaccgtgcttccgaaaaaggacgccgcaagcgggcaggccacctctatcctgggaggcgagaacatgggcgtggttgcaaaggacgacacagcgggcgcggttgcattcctcaaatactatgaccagaccgatgtgatggtggaagccatgaaacagtacggctccttccctccaaagacagaagccgccaaggacgcatactggaccgaggatccggtccaggcagaattcatcacccagctggagacatccataccaagaggaccgtccgcatcctggccatcctattcatccgcaatccagaagggcttccaggaagcgcttaccatggcaaagacgcctgaacaggtggcagaggatacacaggccgcagtggatgctgttaagtagggaaatggcgcgttcataaagacacatgtttaaaagaaaatggctttcatgccagggcgtgtttgaaaatggctttccgtcagctgtgcagatagcgggatgaatgaccagacacgccctggggcgccgcggatgacgcggcgtcggtacggttcacgggccgccggtacggttcacggaccgccggtacggttcacggaccgccggtatggttcacgggccgccggtatggttcacgggccgccggtacggttcacggaccactgacacgattcacgggccacggcctgttttatgtccgccccacagggggcgcaggtgtgtttggacattcatttccataaacagggcagcttggcttgtgggaagcaatgtttaaatacaccgccagatggagagggaggatccggatgaagggaaataagagaatggacacggctgccaagatgggctttctgtttgcagccccggcagtgctgtatatgcttgtgttcatcggctatccgatgatacagaatatcatactgagttttaagaatgtggatgtatacacattttcagacgccacaaaacagaattttgtagggttccgtaattacatggaactgtttacaggaaagaattccatcctgtcaaaggccatcatgaacaccctgatttttacggtgggatcgatttttttccagttcatcattggctttggcctggccctgctgttcaataagaaattccccggctgttcctttttccgcggcgtgaccatgatatcctggcttctgcccgtgacggttgccgggcttttattcaagttcatgtttgccagcagcggaggcatcgtcaaccagttccttatggggcttgggcttgtaaaggaacccatggactggcttttaaagccgggccttgccatgactgcggcagtggtggccaacatatggattgggatcccgtttaacatgatgctcctcatcacggggctgaccaccattccgggagacatatatgagagtgccagcctggacggggcgggcaagcttcagaccttgttcctgatcaccattcccatgatcaaaccggccatcatgtcggtcctgacccttggatttgtatacaccttcaaggtattcgaccttgtatgggtaatgacaaagggcgggccggtcaattccacggagctggtgtccacctacgcctaccgtctgtcctttgaggaattccagttcagccagggcgcggctgccgccaatgtgctgtttttaatcctgctggtggtgggatgtttctatattaagacaatcagcgatgatgaggtgatgtgatatgaagaaagagaataggagtaaactgatttcattcctgttaggcggtctggtgttcctgatttttattttcccgctgtactggatgattgtcactgcccttaagacccaggtggagatattctccataccgaccccgctgtggccaaagaacctgacctttgaggcgtttgccaagcagctgtccacttcaggggataccctgaggggatttaagaacagcctgatcatatcctgcggcgcgacggtcattgcaacggtgctttcgattccggctgcttacggcctggcccggttccggttcggggccaggaggggactggtgctgttcttcctgattacccagatgcttccatccaccctggtactgacctccctctacatcatgttctctaaaatgcatctgctgaacacatactgggcgcccatcctggccgacgccaccctgggcatccccttcagcatcatcatcctgcgcacgtatttcgtatccataccaaaggaactggatgaggcggccaagattgacggctgcggtcatgtgtctgcatttaccaaaatcatgctgcccattgccaaaccgggaatcgtggttgcagctgtgttctcatttgtatatgcatggggcgatctgatttacggcatcaccttcatcacgaaccccaatatgaggcccattacctccagcatctataattatgtgcagcagtaccagaccttgtggaattccaccatggcatttgggatcattgccatttcgccggtggtgctgatattcatcttcatgcagaagtacattgtaagcggactgaccaacggcgcggtgaaggcgtgatggacctgcgggaataaaaaacaaaaaaggagagggataatgaaactgcatccggtagatttaaagaaaatacatatcaatgacccattctggtcaaaacatgtttcccttgtaaaggaggcggtcatcccctatcagtgggatgccatcaatgacaggataaaggacgcggagccaagccacagcctgatgaatttcaagattgcggcgggcctgtgcgaaggggaattttacggggccgtgttccaggacacggatgtggccaaatggctggaggcagtggggttcgcccttgcggcacaaccggatggggagctggagcgcaccgcggaccaggtcattgacatcattgcaaaggcccagtgcccggatggttacctaaacacctactttaccatcagggagccggaaaaacgctggagcgatttgtgcgaggggcatgaactgtatacggcaggccatatgatggaggcggccgtggcctattatatgggaacgggcaaaaggaagttcctggatgtggtgctgcggtttgcggatctgatctgcgataccttcggctttgaggatggtaaaatccatggataccctggccatcaggaggtggagctgggcctgattaagctgtatcaggtgacgggggaatccagatacctggagcaggcaaaatacttcattgacgccaggggcgtgggggagaactatttcctgaaggaactgaaccgtccgggattccggtacattttcccggaattcaaggattatgagccaatctattcccagtcccacctgccggtccgtgaacagaagacggcggagggccatgcggtgcgggccatgtacatgtatagcgccatggccgacctggctgaggcctgcggggatgattcactgatggaggcctgccgcaccctgtgggacaacatgacccagaagcgcatgtatatcacgggcagcatcggttcatccggtatcctggaacggtttaccacggattacgacctgcccaacgactgcaattattcggaatcctgcgcatccatcggcatggccatgttcggccagcgcatgggcaacatcacccgggaggcaaaatactatgacgtggtggagcgcgccctgtacaacacggtgctggcaggcattgccctggacggaaaaagctttttctacgtcaatcccctggaagtgtggccggataactgcctgccccgcacgtcaaaggagcatgtgaaacccatccgccagaaatggttcggcgtatcctgctgtccgcccaatattgcaaggacgctggcgtccatggggcagtatatctatggcgtggacggggaaagcatctatgtgaacctgttcatttccaatgaaaccacggtggatatgggcggcagcgaagtgtccgtgaccatggagaccaggttcccgtggaagatggaggtggacattaccttaaggggagtgcctgaaagcggcatgaagctgtctgtaaggataccggattatgccgggaattttgcggtaaggtatgttggggatgtggggcaggcagatggatatggccctgcattggtccgggaaaaaggctatgggatcatttcccttacaggggatgtgtgcctgcatgtgacatgggacgcgccggccaggttcgtgcacagcaatccgctggtccgggccgacagcggcaaagtggcccttgtccgaggccccatcgtatattgtctggaggaggctgataacggctccaacctggcggcggtttatgtggatcccggcactcccgtggcggaggaagaaaaggatttgttcggaggaatcatcgggctgtcctttgccggtaagaagatatccggccgtgaatggggaggggacgaactctacggcctgcaccccgtcacctgggaggacgtgaagctgaaggcggttccctatgcctgctggaataacaggggagtgggggaaatggttgtgtggatgaaggagttatttaaaatgtaattgaatcgattggattgttataaaatgccggaaactcaaaaagattgggactctggcattttttagtttggattatggatgtggaaatatttcgtgaaatcatcatagtcatcatagacatgcttctgctttagggatatgattaagataccattgcttccctttcctcaatcatggcagattgtatgattcatctgcaaaaaggagtctggaatgatgaatgccctgacaaagaaactattagccctattccttccggggctggcctgcatgaatttattatcatgctgttctgtcccgtctgccccagattattcggacgaagcagcacaaccggctgacatgtataccatagataccatagataccatggatgaagcccgggaagccaaaaaccaatacaatgcctttctggaacaggaggatatgtatgcactcactgccactgcagcatatccgcggggagacagccgtgcaaaatatgcaattggtgactgtacaggagatgatgtgccggaactccatttgacctttgggacaaactattacatttatacataccgggatgaggaggttgtacttctgcgggatttctcccggtatcccctggtaattccggctgaaaatggggcaatcatagtatcggaacgctctgaaaccggagatgataccatccagtccagctatcggataccacaaccggatgacccttttgccgaaacattgcgggtggaaggaagcagggactattatggttacctggtacttgatgaatacggctatccaatggattccaaatcccagtcttttaccagtacctatcagggaaatcaaagtgatgggaagtatctctatcatatgaatgaaaaggaatgtacaaaggcagaatgggaaaaagaagtgggaatctgccttgaaatcatggaagatgagtcaaaacagatggcatgggagtatattttccccaaagaagaatgggactatttagatgccatggaagaaggaaatggtgtccaggaggatatggacagcggggaatgggcgttctatcaacggctgctatccggtgaatatcaatggtttgatgcggcatcccagtccaggttccattccagatatatggccagtctggatgaaactaccggaagaagtaacttaaaatatattttgatggactttaatggcgatggcagccaggatttattcattcagtatgatccattccctgcgaattataccacagctgacttttcctatgaaaacgtaagcagatgcatcggttttttcagctatgcagatggaaaaccctatggatggatcagcgatggagctacaggcgtacgcttcataccactgcggaatggacagatgattcatatggaaggttatgctgttacagaagacctttatcttggcgcgtcccattccagatactccggcttgagtgaaattgaaaaagcatatcacctggtatatgtagatctttctaacgaagattacttttatgacagggattggtacgaaaattcatatggtaaggacagggtgttccatcagggtgagacccttcattttgtgcaggagtatatggatgaccaccctgctggtggacaaaaagaactttcagaagaagagtgggcggctgttgaggaaatgattggggaacttctgattccagacagtgaatggaaaccagcttccgtatttcctcccaaccgttacccggccggtttttctcagggatgaggggagggagtgtctgattccttatctttgtatacccaaatgccttgacttctgtttacaaccataataaaataaagaatggatgattttgggcgtacttccaaggtacgtcctattttacacaatggaaaacggaggacgaacattttgtcaaagatagatagccagctggcagaagagataaaaaagcggaggacatttgcaatcatatcccaccccgatgcaggtaagaccacactgactgagaagttcctgctgtacggaggcgccatcaacctggccggtacggtcaaggggcgcaaggcagccaagcatgctgtttcggactggatggagatagagaaggagagaggtatctccgtcacctcttcagccatgcagtttaattatgagggattctgcatcaatatactggatacgccggggcatcaggatttctcagaggacacataccgtaccctgatggcggctgactcagcagtcatggtaattgacggttccaagggtgtggaggcccagaccatcaagctttttaaggtctgcgtcatgcgccatatccctatcttcacattcatcaataagtttgaccgtgaggccagggacccatatgaactgatggacgagattgaaaatgtcctgggcatccgcacctgccccgtaaactggcccattggctgcggaaagaattttaaaggcgtgtatgaccgctttaccaggaagataaccacctttacggctgccatgggcggcgccagggaggttgcaagccaggagtatgggctggacgacgggaatctggaggatgtaatcggtttttcctaccaccagcagctgatggatgatatcgagctgcttgacggggccagcgacgagatggatatggaacgtgtacagcggggcaacctgtctcctgtattctttggttctgctttgacaaacttcggtgtggagacattcctggagcatttccttaagatgaccaccccgcccctgtccagaaggacgctggatggggaaatcgacccattccgtccggatttctcggcctttgtgtttaaaatccaggccaatatgaacaaggcccacagggacaggattgcgttcatgcgtatctgctccggcaagtttgaggcggggatggaggtcaaccatgtccagggcggcaagaaaatccgtctgacccagccccagcagctcatggcccaggaccgcaagattgtggaggaggcatatgcaggggatatcatcggtgtgtttgacccgggcatcttctccatcggcgatacgctgtgcagttccagtgagaagtttgaatttgagggcatccctacctttgcgccggagcattttgcaagggtgcgccaggtggataccatgaagcgcaagcagttcatcaagggcgtgaaccagattgcacaggagggcgccatccagatattccaggaattcaattccggcatggaggagatcattgtgggcgtggtgggcgtgcttcagtttgaagtgctgacctaccgtctccagaatgaatataatgtggaggtcatactggagaagcttccgtttgagcatatccgctgggtggagaatccgggccaggtggatgtggcaaggatccagggcacttctgatatgaagcgtatcaaggatttaaaggacaatcccctgctcctgttcatcaacagctggagcgtgggcatggtcctggaccgcaatccgggccttgaactcagcgaatttggcagggcgtaatataagcatgccctattagcggcatgtggaccatcatgaagtattccggtccatcgtaccggggaaagcaggaggtatctgacatgagtaagattgacattgtaagggccgccatggtagaagccatgaaggccaaggacaaggcaaggaaggattccctttccatgctgctgtcagcactgaagaatgctgagatagataaaagggagcctctcacggaggcggaagaaaatgcaatcgtgaaaaaggaaatcaaacagacccaggaaacctatgacctggctccggctgaccgtgaggacatccggggggaggcagctgcccgtctggccgtttacagggaatttgcaccggctgacatgagcgtggagcagatcacccaggtcatccggtccgtacttgacgaactgggcctgaccgaacccacggccaaggataagggcgccatcatgaaggtgctgatgcccaaggtaaagggcaaggcggacggcaaggtggtcaatgagacgctggcctccatgcttaagtaggaaggcagatattgttatgacctgtaaaatataataacgcggagccgtcttcgcggatgaaggagatttgacatggattacagaaaagaaattgaaggatttatggatgcccacagggatgagatgattgaggatatctgtacgctctgcaggattaacagcgagaagaaaccctatgtggagggaaagccctatggggagggaacatttgaggccctgaatgcagcacttaccatggctgagggatatggattctccatcaacaattatgacaattatgtggggacagccgacttaaatgacaaggaaaggcagttggacatcctggcccacctggatgtggtcccggcaggagagggatgggttgagacggctccctttgaaccggtggtaaaggacggcaggctttacggacgcggcaccgcggatgacaagggtccggcggtggcagcgctttatgccatgagggctgttaaggaactgggaatcccgctgtctaagaatgtacgcctgatcctgggcacggatgaggagtgcggaagctctgacattgaatactattacggcagggagaaggaagcgcccatgacattttcaccggacgctgagttccctgtaatcaacattgagaaaggccgtctggagggacattttaacgcatccttccaggcctctgaggcagtgcccaggcttgtgaaggtggaagccggaatcaaggccaatgtggtcccaggcaaggcaaaggcagtggtggagggcgttgaccttgcaacactggaagggactgccagggaagtggaagcagggacaggggtatcctttggctttgaaggcaatttccctgtaatacagattacggcccaaggtgacggcgcgcatgcatccacgcctcaggagggcaggaatgcgctgaccgcactgctcttatacctgacccggctgcctcttgcgcagtgcccgcagatggacgccgtaggcgcccttgtggaactgttccctcatggcgatacctgcggaaaggctgccggcattgccatggaggatgagctgtccggtgccctgaccctggcattcagcatgctgaccgtatcctcagacagcctggaaggcgtattcgacagccgctgcccaatctgctccaatgaggataatgtgctgaaagcggttaagaagaacatggctgccaagggcctgacactggaaaatgaaaccatggtcccgcctcatcatgtggacggcaactcccattttgtcaggacacttctggccgtatatgaggagtacaccggacttaagggaagctgtgaatccacaggcggcggcacatatgtacatcatctggcgaacggcgtggcatttggcgcggcgcttccgggaaccgataaccatatgcatggcgcggatgagtttgcggttgtggatgagctgctggtgagcgcaaagatatttgcacaggtcatcgtggaactgtgcagctagtgtgctatcaggaaaatagacaaggaggtttgcctgaatgtcatcgtgtcagtacactagttttaaatactaaaatatatgcatgatcatgacccccttgctgactggatgactggacctgatgaccggattgatatggattcatggaaaggagaaagcagcatgggcggtttaatcggattatcgggacagccctttaaaggtatggaaaacagccttttgcggctgtcccgtctgcgtggtgcgaaggaaggaaatctgcaggggcaggatgcactggggaagaaagcacaggggcaggatgtactgggacagaaagcacaggggcaggatgtaccgggacagaaagcgcaggggcaggatgtaccgggaaagaaagtacaggggcaggatatgccggggcagaaagtacaggggcaggatgcactgggacagaaagtgccggggcagaaagtaaacggtgagatgtctgagacagaaggcaatgcccggacggaccggttccagtggtccgggaataggggactgcctgaggatatgctgtccgggaacctgatgggaagcagtgggaagacattggatgaatccgctgtgaaggctggtgtgatccaggtttctacacaatcatcgttccaggtatccaaacagtacggcaagatggcatctgcccgttccaccgcccaggtacagcaggtcatgggggatatacagcaaagcatcatacgtcttaagacagcagcggtatatggtgatgatgagcagagggttaaagccgccagggctgtccgttcccttcagaagctgttgggcagaggcggcaggaagctaaggcggttaaaccgggaaaagctgaagcagtgtgcgcagaaaaaggcgcagaagcagagggaagagcggaaaagccgcagactgaagctggaattaaaacgcatgcgttcagctggaaaaggaagtgattataccctggtgcaggaggggatggcggatgaggcatatatccgtggttaccgcagatacaggatggcaagggatgcatacagccagccggttccggggacagggtacatgactgccccggtattgcccggcggcatgggcaatggcactgacagtggtatgggcagcagcgtgggcagcggcgtggcagctgaaagcggcggggaaatcattcagggagaggttgtggtttccagcgattcctccttatagggaaatgggggccgctgtgtcatggggcaggcaggaagaagatggaggatgtaaagacgggtatgaaaatgatgaaattattgccggtactattagctgcagctattgtcatgacagcggcggctggctgcggttccagggatgacagccaggcagtaaaggaaactgaggcaggggctgcggtcacgtcttccccggcagccaatccggccggtggggcaggggatggatccggtgaggaagatggggctgggaatgcagatgcagccaatggggcagataaagccggagcaacagataaaactgaaacggaagataagaccaaggatacggatccatccggccaaacaggagaaggcggcgcggaggaggcctacagcaggataccggatcctcccgcctcagacggaagtaagatacttttcgtgggcaacagccatacctacaccaatgaccttcccggcatgttctattcaatggcagaggcaggaggacacaaggtagatgtatacgacctgacggaaggctactacacgcttaagatgtactctgatcctgaggatgaactgggaagcgtgctgacggaagcgcttaagggtgaaagctgggattttgttgtattacaggagaataccaatgcctccattgccctcaatgcaaagaaggatatgtatccatacgcccgccaactggatgggatgatacaaaaggcaggcggacagaccgtattcctgatgacctgggcgccaaaggacggggccggcgtcctcagccatgagatggtacagacccagctgtcactgggatacaggaccattgctgaggagctggatgccctgttgattcccggtggggaagtatttgaggcagcaaggaagcaggtggaaggcctggaactgtggggtgaggacggacagcacccatcggaggaaggcacatatctggccgcatgctcggcttacgcgctgctgttccaggagtcgccagtgggcaattcatttgtgtcggacctggaccaggcagtggcaggggaactgcaggaaattgcagatgcttacatactgggtacaaaaaagtcttgacaaatgagtatgagtgatgtatcttcttaactaagacaaatcctagttgattaatagagaataagtacaggaggatcttatgaatcagttcaaagccatgcagatgaatatggatatgatgaacggcatgtacatgatgatgtgctgtgtatccgcatgggcaaaaaactgaatgtaagtttcatctgtatggattgtgattaattgagattgagttgcattgaggaaaatgcttcgaggccgcaagtccgtgcaggacgtgcggcttttttggagtgcaggcggtccacaaggtcaggatccagatgaacgaaagaaaggaaatgaaatcatggaagagaacagagaaaatcccattatccggctggaagggctgggtaagcagttccagacatccggcggtccggtcacggcgctggaggatatcaacctggagatacgctacggggaggtatttggaatcatcggactgtccggggccggcaaaagcacccttgtacgctgcatcaactatctggaggtgcccacatcgggcaaggtaatattcgagggagagaacctgtcagccatgaaggacagggagaagcgcctggcaagacgctccatgggaatgatattccagcagttcaaccttctggcccagaggaatgtgcttcagaatgtgtgcttcccgctggagatatccggggtatccaaatcagaagcaaaaaaacgggcggaagagttactgaggctggtggggcttgaggacaggatgaaggcatatccggcccagctctcaggcggccagaagcagagggtggcgattgcacgtgccatggccaccaaccccaaggtgcttctgtgtgacgaggcgaccagcgccctggaccccaacaccaccaaatccatcctggaacttcttaagaagattaaccgggaaatgggaatcacggtgattgtcataacccatgagatggctgtaatcgaagcaatctgcgacagggtggcaatcattgaccacagccatattgcggaagtgggaaaggtgtctgagatattctcaggacccaaatcagatatcggccgccagctgatcctgggggatgtgggagcccagggaaccagcttcggacagtcccggcagatccgcattatctttgacggaagggaatcctcggaacccgtcatcgccaacatggtcctggcgtgtaaggtcccggtcaacatcatgcatgcggacaccagggatatcgaaggaaaagccatgggccagatgatcatccagctgccggaggacgagacggatgccggaaggatctgcaactatttaaaaacagcccacgtggcatttgaggaggtgcgttaagatgcagtttgattcaacaaccattaacatgctcataaagggaattggggaaacattctatatggtgctgctgtcctctgccctgtcctatatcataggcattccgctgggaattgcactggtcgtcacggacaaggacggaatcagcccggttcctgttttcaacaaggttcttggagtggtgatcaaccttctgcgttccgtgcctttcatcatcctgttaatcatggtaatccccatcaccaggctgattgtaggtaagatatatggctccaacgcaaccgttgtcccgctggtgatttcagcatccccttatattgcgcgcatggtggagtcttccctgaaggaagtggatgcaggcgtcatcgaggcggccaaatccatgggggcctccacctggcagatcatcgtgaaagtcctgctgccggaggcaaagccgtccctgttggtgggggcagccatttccgtgacaacaatcttaggatattctgccatggcgggatttaccggcggcggcggactgggagatatcgctatccgctatggttaccaccggtaccaaacggatatgatgctggtgaccgtagtgcttttggtcatcatcgtacagctgattcaggagatattcatgcgcatgtccaggagaagcgacaagaggatccgataggttttaaaggaagtcaatccggcggaacaactgtgtaccgccgttgccggaatgatccggcaacgaagggaacacctgccggctgatgataaaatgcccgtaaagggtaaataagggggcagccccgaaatgaggaggaaatcattatgaagaagagagtattaggcgcagccgtactggcagcagcactggcagcaggggcacttaccgcctgctcaggaactgcaaaggaaaccacggcagctgagacagcggcagggacatcagcagaaacaacagcagccggagcagacgcgcaaaccactgaggcaggttctgaagcagcagataccacagctgccgcggatcttcagaaaatcattgtaggcgcaagccctgcaccccatgctgagatcctgaatgcagccaaggaagtgctggcatccaagggttatgagctggaaatcgttgaatacacggactatgtacagccgaacaacgcactggacacaggcgacctggatgcaaactatttccagcataagccatacctggattccttcaatgcacagaacggaaccaagttagtcagcgcaggagccatccactatgagccgttcggcatctatggcggaaaggtgtcttccctggatgaactgcaggacaaggcagccgtgctggtacctaatgatgtgagcaatgaggcaagggcgcttttacttctggaagcccagggcttaatcaagctgaaagagggcgtgggcctggaagcaaccaggaatgacattgtggagaacccgaagaatctggaaatcgtggagatggaggcggcgcagcttccccgttcccttccggatgcggatattgctgtcatcaacggcaactacgcaattgaagcagggcttaaggtaagcgatgcactggcaaccgaagactcccagtccctggcagcaaccacttatggaaacattgtggctgtaaaagaaggcgaggaaaacagcgatgccatcaaggcgctggtagaggcgctgaccagcccggaggtaaagcagttcatggaggagagatacgaaggggcagttgttcctctgttctaaaccaaccttataatatgtggtgtgtaagccgtaatccgccgggacaggttcccggcggattgtatttttttgtaagttatgatatactcttcacgtatgattggaccggattgtaccggcataagaaaggggactatacatggattacggacatggtaataccagccagtcaggggaaggcagtgcccctgattcaaataggacagacagaaaccaggcacccaatgaaccggtggtcgtggcggaacagccggcatgtccggtggatcccgacacggatgacagcggcaatggatggagccagccaggtccccgtggatatgaggaaagcgcttggagccagccgggagaggtaccgccccggcaggaaatctggagccgcccggaggacaggcagaattgcccggaggacagccggaaccgttcagaggccagccagaacagcccggaggccagctggaaccgttcagaggccagccagaacagcccggaggacagccggaaccggaacagttccagcgggcagtctgatggcccttgccagtcaggcgcactggatcagggaaggaaccaggacaaaggacagccggaacataagccggagtacaagacagcgcctccttcctattcaggacaggccgggaaccagtattacgggcagggaagtgcaggccggtcacagaaccgctcccaaagccagtatcaggggcaggatgaatatcagacccagtatcaaactcagtatcagacccagaccagcggccggaaccaatatcagaaaccgtctgaagaaaagaatgggatggcaatcacttcccttgtcatgggaatcctgtcccttgtcacatgctgctgcggctggattgcacttgtgctggggattctgggcatcatattcgccatcttatcaaggggtgaagacagtatgtgcagccaggccaaggcgggattgattctttccataataggcgtttcaattgcaatccttgtaatccttgtatatattgggctgcagatgttatccatcattccggatacgttttaaaccgttgtccaggtccgtgtcctgaaaatcatcctgaaccggatccgggattctaatacccgtaacggctgcatatataagtagtaagaagctgccggagggatagttacgcgaatttatgatctcaaacagaaagaagttattaatgtgaagacctgcaaacgtctggggtttgtgggggatgtggatttcgatatggagactggctgcatgctggcccttatcgtacccggtcccggatgtatctgcggtttcctgggcagggaaaaagagtatataattcccttctgtgatatctgtcaggttggaaatgatattatactggtggatataaaagaaaaagatgtgtcggaaaatataaaatgctgaatcccgccgccaggcacagaaccatctgatgtctggcggtatttgcatgaaagggaggagtggccggcaggattcatcctgccggccggtttgtgagaaaaagttgtatgaaaagcattagcttttttacattttcaaggatacataaaaaatgtgatgattctatgtggaaaatgtgaaaaaaatgtgaagctgcattagagcatgtctatatgctgggattcccacacacgcctatgagggcaggcacccctggcgccgccatcactgcgtagataaaggggcggttcagtatcatttcccctgacgcttcccctggaagggaaccgtccagcggggggatgacaaggcaggaggcggcattgatgccattttcatccatccggatgccggatgcctggctaatgcctgacaggcaggcggggctgtcagcaaggccggaaaaatcagcctggcccggcgtaaatacctgacttaccccaagatcttccaggattggacgcagttccagacaggtgccgtactggaatttggggatgtttaaggttatccgcccataaggttcattgataatatgcccgaacatctccgccatccgttcctcagatgacagcagggcctgaggggtaaagccctcatcaggcagtacgaggatcagggtactgttttctttcagggaaatgacggccctcatgaatccctgaccatggtagtagctgcagttcctgctgtccgtcatatattcacatgtgactgcctggccgtccgcaggatggaattggccggatacattctttgaactgtcaaaatgaaatacccactggctgctgtaggacatggtatccaacatgtgcatggtttcatcctgcgacagtacaagcccgggggaaatgccctggtttccatgatccatcagccaacggttcatgactgcggctgaattggcatgggtcaaatccatgcggaagacatcagaatggtattgctgttcaatcatccttctgagattggaatccaggggacttccatcgttcagccacatggaactgactggtttaatcatgctggcttcgttgtcacggtacatgagcctgtacaggctgccgcattcagccgccatctggctggcatcttgaccgggggatgtgagcagtccgtataactggttcctggtactgccgcccgcggcctgggccgccagggccagggagtagtagaggctgactggcgagtaacactggtttacctggctgtcctttaacacggcggaggctgtcttgtatgaaaagcttgtgattccagccaggaatccatcgctcagcgtgctattttgctggatggcccgctggcttccggcatcgccataggcagcggcagccggacgggcggcaaatgcctcctggcggtaagggatgccagcctcctgctgtaccggaggacggccggaaccggcagcgccaggtccggcttctgctgatacgggaatggcggggatgagcataaaagagacggccagaagcccggccgtcatttgggtaattgtattccttatcatattgcaatccctcctgacatgatggtaacagggttcttataatatcattgtatcagattcaggaggagggcgtatttcattttccttaattaaatcatacaaaaaccgcattgcatatggcacggctgcaggaacaggcaaatgaccagaaaagcggcgggccggattacaggttcctgtggatggtttccagaatcccgcgcagttcccccacatcaatctgtccgggtgccgaggccccgcccgcagagccgaaggtcaggcaggaaccaaagacctcgccgcttaaacggctgatgagcccggtgcctttcatggacatggaaatgacctggcaggaaagtgtgcgggaagctttttccgtggctgacaaaagggtcagtacatcgctggccgaacccggcatcacggcaatcttggcaatatcagcgcccaggaagtccatccgctccagacgttttaacagctccttttcatcgggcgttgcggtaaagtcgtggttggagaggatgacgcccacgttgttttcgtgggccagcctaatcaggtcccggaccgcatggtcatcggaaaacagctctatgtccaccaggtcggctgagccggaacagatggcgcgttcaaggagggtccggtaatcggccgcggatgcaggcaggttcccgccctccccatgggtccggaaggtaaagagcaggggaatcctgccaagggtccgggccaggacgggcatcaccctgtcaacggcgccggggtccagtatgccgacataccagtcagccctccactcagccacatccacaggaagggtggtaaaacgtccggcttcccgtataagggaatcaaagccggtttccaccagaggcgcgcatatcttgggaatcccttcccccagtattacatcttttatcttcacattattcatatggaaccagcctttctttgttctgctatgggtcttattataaaacggggagggagattcgtccatacagttatgaaaataaatacaaagtccttgcgattcatagatgattcggttaaaataaatgcagcacgaaagccgtgaatagaggaaaggaagtattgaaaagatgaaatgcccttattgcaacgaatcagatacaaaggttatcgattccaggcctgccgatgacaacagctccatccgcaggcgccgccagtgtgagagctgcggcaagcgttttaccacatatgagaagctggagaccatgcccttaatggtgattaagaaggacgaatccagggagacgtatgaccgctccaagattgaagccggaatcatccattcctgccataagcgtcccgtgtccacccagcagatcaacacggtgattgacgagattgaaaaccagatattcaacatggaggaaaaggaagtccccacctctgtcatcggtgagctggtcatggagaagcttaagatgctggatgaggtggcatatgtgcgttttgcttccgtatacagggaattcaaggatgtgaacacatttatagatgagattggaaaactgcttaaaaagtagacaaggaaggattaacgcggattatgctggaaatgttttatccacagcggtatgaggtttctgcctatgtgattccatatgcccattaccatgcccagggaatcaggggcgtcatatttgatattgataatacgctggttccccatgacgcgccggctgatgaccaggccagggaactgttcaggcatcttcatgagatggggatggatacctgcctgctgtccaataataaggaaccaagggtcagggcctttgcggaggatgtgggttctgcctatatccataaggccgggaagccggggacagccggttatgggaaggccatggagcgcatgggcacggaccgggagagcacgctttttgtgggggaccagctgtttacggatgtatatggggccaaccgggctggtatcctgagtattttagttaaacccatcaatccaaaagaggaaatacagattgtcctgaaacggtacctggaaaagccggtactgtatttctacaaaaagcaccgccgcaggaagccatgaggcaggcgccggaccgtgacagatcatgttattatcatagaatgaacagcagggagcgagacggaaaatggacggaaagacaagagtatgcggactgatagcaaacccggtggagcattccatgtcaccactgatgcagaatttttatgcggagcgcacaggcgtgaacctggcatatgtgccgtttaaggtggaggatgagggggtaggcgatgcggtcaggggtgcatttgccctgaatatcctgggactgaacgtgacggtaccccacaaacagcgggtgatggaatacctggcggatattgatgaggatgcccgggcaatcggcgctgtcaataccctggtgcgggtacaggacggatataagggttataatacggacggtgcaggtttaaaacgcgccctggatacggctggtatcgggatctgcaatgaaaactgcatcctgattggggcgggaggcgctgccaaggccgccgcttatgtgctggccaggggaggcgccaagtccatcttcatactgaaccggagccaggaaaaggccggtgagctggcggattacatcaacgggctgatgggccgcgccatagcgtccgccctgccgcttgacggatatggcgccctgccccggataaggtccggttatctggcggtacagtctaccagtgtgggcatgtatccccatggggaccaggtggtgatagaggacccgcgtttttatgagctggtccacaccggtgtggatattgtgtacacacctgccaggaccaggttcatggaactggtggaggaagctggaggcaaggcggttaatggcctggatatgctgctgtaccagggaatcattgcttatgaactgtggaatccccaggtgcgggtggatgaggaaaccatatgcatggcaagacggttgatcgaggaacagctggccggggccaggtccaagcacaacctgatcctcatcgggttcatgggtgcgggaaaaaccagtgtgggactggcctatgccaggcagtacggaatgcccatcattgacacggaccagaggattgaggaggctgcgggcatggccattgcggatatattcgccacccagggcgaggatgcgttccgaaagcttgagacaggggtcttaaaccagcttctggcccacacggaccatgccatcatatccgttgggggcggacttcccctgcgggaggaaaaccgggcccttttaaaacagctgggctgcgtggtctatctggatgtatcgccggagaccgtgatggagcggattggaagggatgtgtccgaccgccccatgcttcagtcggaggatgtggagggaaggatccgcgaactgctttcctatcggcgcccggtctacgtggatgcctcccatgtgattgtggatgtaaacggccggaaggtggaggaaattgtgggggaaatccataaaagggcagggatttagaagaaatttggagaaatttacactgccaataaaaaaaaccttgaaaatgctgtctacatagtatagaatataaaagattaaagacttattgggcgctgtgtctggcgccgtgaacgaactcaaggaggaatatctttatgatatcagcaggtgattttagaaatggtgttacactggaaattgatggacaggttgttcagatattggaattccagcatgttaagccaggcaagggcgctgccttcgtgcgtaccaaacttaagaatgtaatcaacggaggcgttgtggagcgcaccttccgtccaacagaaaaattcccggcagcaaggattgacagggttgacatgcagtacctttatgctgacggcgagctgtataacttcatgaaccaggaaacatacgaccaggtagcgctgaacaaggatatcatcggtgatgccctgaagttcgttaaggagaatgaggtatgtaaggttgtttcttacaacggcagcgtattttccgtggagcctcccctgtttgtagaactggagattaccgagacagagcctggattcaagggtgatacggcacagggcgccaacaagcctgccaccgtggaaaccggtgcgaccgtgtatgtgcctttattcgtggagattggcgacaagattaagattgataccaggaccggcgagtatctctcacgtgtataatggtctgtagagaaagagcttaaagattgctccggcgtcagccggggcacttttagctttcccggaaggaaatgttagagcaaaggagaacgtgaatcgtgaagaaaattctggacttaatggagcaggaactaagacaggcctttgaagcctgcgggtatgaagcgaagttcgccaaggtcgtactgtccaaccgcccggacctgtgtgaataccagtgtaacggcgccatggcagcggccaaggcctataagaagaagcccattgacattgccaccgcagtggtggagaagctgactggcgcaggcgcggatgcggctggtgcacagacaggcggcgcggatgcggccggtatgcagtcaggcagcgcccatcccgtattcagcgaagcagtggctgtgatgccgggcttcatcaacctgaaggtgtctgggcagttccttgctgattatatggtgcgcatggctgcggcggataagctggggctggaagccccggaaaagcctgagaccgtgatggtggactacggcggcgccaatgtggcaaaaccccttcatgtgggccatttaagggcggccatcatcggcgagagcattaagcgcatgggccgtttcctgggacacaggacaatcggggacgtgcatctgggggactggggccttcagatgggccttatcattgaggagctgagggacaggaagccggggctggtgtattttgatgaatcctttacaggggaattcccggcagaggcgccatttaccatcagtgaactggaagagatatacccggctgccagcgccaagtcaaagacggatgaggcgtttaaggaaagggcccaccaggcaaccctgaagcttcagaaagggtatgccccgttccgggccatctggcagcatatcatgtccgtgtcagtggaggaccttaagaagaattattccaacctgaatgtggaatttgacctgtggaagggcgaaagcgatgccgagccttatattgcggacatgatccagatgctggtggataaaggcctggcttatgagagccagggcgcccttgtggtggacgtggcagaagagacggacagcaaggaaatccctccctgcctcataaggaaatccgacggcgcttccctgtatgccacctccgaccttgccaccattgttgagcgtgagcaggatttccatccggaccgctatatctatgtggtggataaacgccagggcatgcattttgaacaggtattccgggttgccaagaaggccgggattgtaaaacaggacacccctatgatatttctgggcttcggcaccatgaacggcaaggacggaaagccttttaagacccgtgagggcggcgtcatgcgcctggagaccctgattgcagagattaacgaagcagtgtatgcaaggataatggaggatgaagagcgcactgtgtccgaggaagaagccaggaggacggcgggcatcgtgggcctggcagcccttaagtacggggacctgtccaatcaggctgtcaaggattacgtgttcgacattgagcgttttaccgcattttcaggaaatacaggaccttacatcctgtacaccattgtgcgtatcaaatccatccttaacaagtacagggaaaatggcggcattgtcagtgaagatgcgctggagaagaatatcctgccggcggccaatgactcggagaaggcgctgatgcttctgatttccaggtacaacgaggtgctggaatccggtttcgctgagacagcgccccataagatatgccagtacatctatgagctgtccaatgcatttaacagcttttatcatgaaaccaagattctgacagagccggatgaggccaggaaggacagcttcatcggtcttataacccttgccaagcgggtactggaaacctgcatcggcctgctgggaatcgaggcaccggaccgcatgtagaggaacgccgaaaggaagcgtcagtccaatgaaaatagtcaggatgaacaccagcagcttctggaaaggggaggctggtgtgaaaggcctggtggaagaccagggcaagacatataatgtaactttatatttagggagtggccgtgtaaaggattactcttgttcctgcgcaaagggcaattcttataagggcatgtgtgcccatggggaggccctttttgcgtattataagcagcagaaggaagaggaatcaaagccgccggtccatacatccaaccaggcccacaccatgatccgtgaatacaccaaccgggaggtggcccagatactggctgaggatgaggccgggcgcgtggggctggaaccggtgcttatcataagcagccgggagatgcggctggaatttaaggccggtatcagccgcttttatgtgctgagggatctgggcgcgttcagggaagcggtggaaaacgggacgtatgttgaatacggtaaggatctggggttccatcatcagaaatcagcctttgcgaaggagagccagggccttttgtccctgcttctcggggtgacggaaaaccagaaggctgtgcgggatatcgtactcagccgtatggacagggaccgtttttttgaaatgttcaccggacgggagatggatgtgcagctggcaggaggactgcgcaccaggatggctgtcctggatggggacccggtcatggtcatccgggtgtcccggtatggaagggacggactgaaggttgcctttgaggggctttcccaggaaaaaaagggacagccaaagaggatgaatgcctgtttcaaaggggaacgccgcctctatgccatcacgggaagcgcggtttactgctgcagtgaggcatttaccataacagcaggtcctttcctggaacagatatccaaggaacgggagggatatgtgctcattgggcagaaggacatccctcttttttacgagcgtgtggtgaaacatataagcccttacagccggctgatcctggaacaggtggattttagggagtatgaaccggagcccctcagggcggccttccggtttgacaccggggaacagggggagcttctcatggaaccagagctttcgtacggtgagtacgtgttccatccgctggaggatgagaacctgcctaagaccatctgccgggatgtgccgggggagttccgtgtgagccagctgatccagaagtattttaaatataaggacccggagggaatcaagctgctgattaaggaagatgaggatgccatgtaccgtcttctggacgtgggactggaggaattccgtctgatgggccaggtctatatatcagagagcctgaaacagtggaaggtggccccgtcccccaaggtaagcgtgggagtgggggtgtcctcggggtggcttgagctgtctgtggacatgggggacctgcagaatgaggaactgtccaggatcctggccgcctacagccagaagaaaaagtattacaggctgaaaagcggccaattcctgaaactggaagagggcggcctttacgcggtcagccggatggcctccgacctgggagtcagccgcaaagacctgcagaaggggaatttccggcttccggcttaccgcgccctgtatctggaccacctgatgaaggaaagtcccggggtggcatactacagggaccagatgttaaaggccatggtccgggggattaagtccgtggaggacagcgactatcccgtgccggagagtctgcggggtgtgctgcgggaataccagcgggtgggctactgctggcttaagacgctggacagctatggatttggcggcatactggcagatgacatgggactggggaagacaatccaggtcataacgcttcttgaagatgcttacggcacaggggaacggcagccctccctgatcatatgcccggcctccctggtgtataactgggaacatgaaatcggcagattcgcaccggatctgcgggtgctttccattgtcgggaacgggccggagagggaagcaaggctttcagccgtccgggagcagctttcaggagaagcaggggatggttatcaggtgttggtcacgtcctacgatttactgaaacgtgacatccggttctatgaggacatccatttcagataccaggtcattgacgaggcccagtatatcaagaatgcagccacccaaagcgcaaaagcagtcaaagccattgatgtcaggacccgctttgccctgacaggtacgccggtggagaaccggctcagcgagctttggagcatatttgattacctgatgccggggttcctgttcgggagccagtacttcaaaaaggagtttgagaccccgattgtcagggatggggatgaggatgcccttttcaggctgagacggatcatcggcccatttgtgctcagaagggtgaaaagggatgtgctgaaggagcttcctgacaagctggaacaggtggtatattcaaactttgagggagagcagaagaaactgtatgcagccaatgccatgaagctgaaggaaaagctggaatcaggaggattttccgaatcaggggacggcaggcttcagatactggcagagctgatgcgcctgaggcagctttgctgcgacccgcgcctgtgctacgagaattataaacatgaatcggcaaagctggagacctgcatggacctggtccgaaggggaatctcgggagagcacaaaatccttctgttttcccagttcacctccatgctggaactgattgagaagagactttcaaaggaaggcatggccagccataagcttacaggggccacgtccaaggaagagcggatccgcatggtgggggaattccagcgggatgatgtcccggtattcttaatcagcctgaaggcgggaggcacgggccttaacctgaccgcggctgatattgtcatccattatgacccatggtggaacgtggcggcccagaaccaggccacggacaggacccaccggatcggccaggaaaaacaggttacggtctataaactcattacgcgaaataccatagaagagaatatcttaaagcttcaggaatccaaacaatacctggccgaccagatcgtaaccgaaggcacggtcagctttggcagcctgacaaaggaagatatcctgaacatagtaacccaggaggtagaggaatgaaagtattgatgttaaacggaagccctcatgaaaagggctgtacctacacagcgctcatggaagtggcgggagaactggagaaagccgggatccagacggaaatcatgcatgtgggcggggatctggtccatggctgcatgggctgcggcgcctgttccaagctgggaagatgcatttataacgatgacaaggtcaacgaggcagtggggaagatgaaggaagcccagggacttatcgttggctccccggtgcactatgcgtccgcgggaggcgccatcacctccttcttagaccggttcttctattcaggcggcgcatatgccgcccataagccggcggcagcagttgcctccgcccgccgggcaggcaccacggccaccctggaccagctgaataaatacttcatgatctcgcagatgccggtggtttcttcccagtactggaacatggtacacggaggatgtccggaggatgtgaggaaggatgaggaaggcctgcagattatgcgggtcctgggccgcaacatggcgtggctgatccaatccattgaggcgggtaaggcatcgggcatcactgtgccggagatggagaaggaaaagaagaggacgaatttcataaggtagctgatagtggatttttatggcaggggccgcggccattggggggcggcccctgccttttcctgccttttgcatccttttgtttcaggagatggcggggattcccgatggatgctcttgattttatttttcaactgagttatactatgaaaatgattaattagctaatcatattatagctaactattaaccggctaactattaaccggataatcaccaacccaatcataaacaaataatatggaaaaggaggaatcatcccatgaaagaaccagaatgcagatggccctttgactcgccgcagcaccgtctgattgagaagtatatccgtgtgacacgtttacaccgaagtgtgattgagcaccagctggaggggaccggggtataccgcagccagcatcagatactcatgtacgtgtccaataacccgaatgtttcccagaaggacctggctaagatgtatggtgtctcaggggccaccatagctgtatcgcttaagaagctggaaaagggaggctatattaagcggctggtggaccaggatgataaccgctgcaaccagatatgcattacggaaaagggcaggacggtcgtggaggaaagcgttttgatattccaacgtttggaaagctgtatgtttgaagggttttcagaacatgatatgaatgtattggggaacctgctggaccggatctacggcaatctggaccgggacctgcaacctgttccatctgaagcagaaagagaggagaattaagtgaagcggtataagaaatatatgactccctatctcagcgcctttatcataggccccctgctgatgctcacggaggtagtcggggaaatcatgctgccaaagctcatgtcccttatcattaacaatggggtcgcgggacgggatatccgttatatcatgaccatcggtatcgtcatggtgcttaccaccttcgtgatggctttagggggaatcggcggcgcctatttctcggccaaggcatccatctgttttacaagcgatttaagggaggacctgtttgccaaggtacaggagttttcctttaagaacatcgacaattattcaaccggctccctggtcacaagactgaccaatgacatccagcagatccagaatgtggtcatgatggggctgcgcctgatgctccgcgccccggggatgttcgtgggcgcgctcatcatggcattcatcatgaacgccaggctggccattgtcatactggtggtcatcccacttttgagtcttgccattgcccttatcctgcggacggcatttcccaggtttaccatcatgcagaaaaagctggaccgcctcaactccggcatccaggaggcactgaccaatgtgcgtgtgatcaagtcctttgtcagggaggattttgaggaaaataaattcagggaaatgaaccaggaccttaaggagtccagcctcaatgccatgaagattgtcattgcaaccatgcccgtcatgatgctggccatgaacatcaccaccctggccgtggtgtggtatgggggaaatatcatcattgcaggggatatgccggtgggaaacctgactgcatttacaacctatatcgtacagatcctcatgtccctgatgatgctttccatggtgttcctccagagttccagggccatggcaagcgtgaagcgcgtgaacgaggtcatggacacacagattgacctgacggatgatcatgcgtcccacaaggaccttcaggtgacagagggcagggtggaattccggcatgtggatttcagctattcgggcagcggggaggaactggtcctggaggacatatgctttacagccaggccggggcagactgttggcatcatcggttccacgggcagcggcaagacctccctggtgcagatgatcccaaggctttacgatgccacgaagggccaggtccttgtggacggggtggatgtaagggaatattcccttaagaacctgcgcgaaggcgtgggcatggtgctgcagaagaatgtcctgttctccgggaccatagaagagaacctgcgctggggcaaggaggatgccacacaggaggagatacgggaaatggcggcaagcgcccaggcagacggctttgtcacctccttcacccatggatatgataccgatatggggcagggcggcgttaatgtatccggcggacagaagcagaggctctgtatcgcaagggcattgctgaaacgtccgaaaatcctcatactggatgacagcaccagcgccgttgacactgccaccgaggcgaagatcagggaatgtttccgcaccaccttaaaggataccaccaaaatcatcatcgcccagagaatcggctcagtggaagaggcggacctgattttggtgctggacgatggaaggatcatcggccagggcacccatgaagagctgcttaaggactgcgaagcataccaggaaatctattattcccagagggaccgggaaacagaggaggtgagtgcgtcatgagcggaaaagaaacaattgcgcaggataaaacagagcagcataggattgaaagcttaaaacggcggtatgggcgcactcctgcggcggctcccaggcgggggcctatgggaggccgccacggagctgccaggatggcttccatgggaaaacggatgccccgcaacagcggacggaccataggacgtctcatgcattatctgaacgaggataaacctaagatgatgcttgcatttttctgcgtcatcgtgaatacggcggccaccctggccggatcctatatgctgcggcccatcatcaataccttcatcgcgccccttgacggcagcccgggcaatccgtcagggctgttcagggccttaacggtcctggccgtcatcttcgtggtgggtgtcattgcaaactacgcccaggccagggtcatgctgactgttgcccagaatgccctgcagaagatccgtaatgatttattcgggcaaatgcagaagcttccggtccgtttctatgataccaattccaacggtgacctgatgagccgttttaccaatgacgtggataccatcgggcagatgctcagcagcaccctggtccagctattttccggcgcactaagtatcgtgggcaccctggcgctgatgctttataccaatgtcatactgaccctgatcaccctggtccttatcccgctcatgatgaaggcgggcggggcggtggcaggacggagccagaagtattttacggcccagcagacctccctgggcgctgtgaatggttatatagaagaaaccgtgaccggacagaaggtggttaaggtgttctgccatgaggacacggcaaaggaggaatttaggatcttaaaccaggacttgaggaataaccagatccgcgcccagttttttggcggtatcatggggccggtcatgggcaatctaagtcagattaactattcgctgacagcctgtatcggcgggctgctgtgtgtgctcaggggatttgacgtgggagggcttacggtattcctcaacttttccagacagttttcacgtcccattaacgagatttccatgcaggtgagcaacgtgttctcggccctggcaggagcggagcgggtatttgcggtcatggaccaggagccggaaccggccgaccacggggatgcggtggtccttaatcccatggaaggccatgtggtccttgaccatgtgacctttggatatgagccggataagataatccttaaggatattaacctttatgccgaaccgggacagaagattgcctttgtgggttccacaggggccggtaagaccaccatcaccaacctgctcaaccgcttctatgatatacagtcaggcgccatcaccattgacggggcggacatacgtcacatgaagagggatgagctgcgaaggaacattgccatggtgctccaggacacccatctgtttacaggcactgtcatggagaatatacgttatggcaggctggatgccacggacgaagaggtaatccaggcggcaaagactgcctccgcccactccttcatcatgcgccttccccatggatacgataccatgctggaaggggacggggccaatttaagccagggacagaggcagctgcttaatatagccagggcagccatctccaaggctccggtgctcataatggatgaggccaccagctccgtggataccaggacggaaaagcatattgaacacggcatggaccggcttatggctgaccgcaccaccttcgtcattgcccaccgactgtccacggtccggggggccaatgccatcatggtcctggaacagggggaaatcattgaacggggaagccatgatgaactcctggccatgaagggacggtactatgaattgtacacgggcatgaaagaactggattaattgccatgaaattaacatataaattaaaaaaataacgattaaattctgtattgtatacaatgtatatttatgctatactaagttggtgaattcgggaagggaccaggcagctcttcccgtattccggcgttttaccggcggcattgccgccaaaggaatattatgaaagaaagagggagagaatccatgggtttggcgacttttataggcggcatccatccgtatgagggaaaagagctgtcagagaacaaaccggtacaggttctgatgccaaagggcgatttggtgtatcctatgtcacagcatatcggtgcacctgcaaagccgttggtggcaaaaggggaccatgtactggcaggccagaagattggagaagcaggcggtttcatatcagccaatgtcattgcttccgtatcaggaacagtgaaagccattgagccgagacgtatggcaaacggagcaatggtaccctccattatcgtggaaaatgatggggaatataagacaatcgagggagtgggggaggacagggatccgtccacgctttccaaggaagaaatccgtagtattgtaaaagaagcaggtatcgtaggcctgggcggggcaggtttccccacgcatgtgaagctgacccccaaggacgagaacgccattgagtacatacttgtaaacggcgcggagtgcgaaccgtaccttaccagcgattaccgcatgatgcttgaggagccggagaagatcgtgggcggcttaaaggtcatcctgcagctgtttgacaatgcaaaaggcgtaatcggcattgaaaacaataagcccgaggccattaagatcttaacggaacttgttaaggacgagccgcgtatcactgtttgtccccttcttaccaagtatcctcagggcggcgagcgttccctgatttatgcggtcacaggaaggaaggtcaactcttccatgcttccggccgacgcaggatgtattgtggacaatatcgacaccgtgattgccatctacatggcagtgtgcaaaagaacccctctgatgcgcaagatcattaccgttaccggcgatgcagtgacagaccccaggaactttagcgtgaaactgggaactaattaccaggaactgttagaagcagccggcggttttaagacagagccggagaaaatcatatccggaggtcccatgatgggacaggcgctgtttggccttgatataccggtaagcaagacttcatccgccctgacctgcttcacaaaggaccaggtggcagagatggagccttctgcatgcatacgctgcggcaagtgcgtcagcgtatgtccaagccatatcattcccgtgatgatgatgcaggcagccctcagggatgactgtgacacctttgagaaattaaacggtatggaatgtatggaatgcggaagctgtacctatgtatgtccggctaagcgtccgctcacacaggcatttaaggaaatgcgtaagacggttgcggctaaccgcaggaagaaagggtaggaggggacataagaaatgactaaattattaaatgtatcatcatccccgcatgtgagaagccatgagaccacccacagcatcatgctggatgtggccattgccatgttgcctgcatctgcgttcggcgtatatcatttcggcttacatgcattattagtattgattgtcacggttgcggcctgtatgctcagcgagtacgtatatgagaagctgatgaagaagcccaacaccttatatgactgcagcgccctggtaacaggtatgatcctggcgctgaacatgcctccggaaatcccggtatggataccggccctgggcggcatatttgccatcatcgtggttaagcagctgtatggcggcctgggacagaacttcatgaacccggccctggcggcaagatgcttcctcctgatatcctttgcaggcaagatgaccaacttcagctacagcggctttgacggcatctccggcgcaacgcccctggccgtgcttaagagcggcgggacagtggatatccctgccatgttcgtgggcaacatcccgggaaccatcggagaggtatccgtcatcgccctgcttgtaggcgctgcctatcttctggtcaagaaggtaatctccatccgtattccggcggcatacatattgacggttgttgtatttgcagccctttttggcggacatggattcgatgtgaattatatcctggcccatctgtgcggcggcggtcttatcttcggcgcgttctttatggccaccgactatgtgaccagcccgattacaccaaaggggcagattgtattcggtatccttttaggcgtactgaccggactgttccgtatcttcggcggttccgcggaaggcgtttcctatgcaatcatcatcagcaacatccttgtgccgctgattgaaaagattacccttcccaaggcatttggaaaggagggcaggtaattatgagtaaagcaggatttatgaaagacgcggccatcctttttgccatcacactggtttccggctgccttcttggcggtgtataccaggtgacaaaggaacccattgcaatggccaccatcgcggccaacaataaggcgtataaggctgtgtttaacgaggctgagacctttgagaccgacgaagccctgacagctgccatcgagggctgcaacgcagacctggcaggcatggatttcggcggggtggaagtggagaatgtgttaaaggcagtggacgcatccggcaatgaactggggtttgtggtcacctccctttccaatgacagttacggcggggtggtgaagctgtccgtgggccttaaggatgacggcaccatcacgggaatcgagttcctggaaatcaacgacaccccgggcctgggtcttaaggccaaggaaccggcgttcaaggaccagtttaccggcaagaatgcccagtccttaagtgtcaccaagtcaggtaatgcagatgacacccagattaatgcaatcagcggcgccaccattaccagcaatgcaacaaccaacgcagtcaatgcagccttatattatctgcataactgtgtcaatgaataggaggtgggatgatgaataactgttcagaacgtttatataacggtattgtgaaagaaaaccctaccttcgtcctgatgcttggtatgtgtccgaccctggccgtcaccacatcagcggtcaacggtcttggtatgggactttccaccaccgtggttttacttttttccaacatgataatttcagcccttcgtaagatcataccggaccgtgtgcgtattccggcctacatcgttatcgtggcttccctggttaccatcgtgcagctgctgcttcaggcctatgtgcccagcctttacgctgccctgggtatctatatcccattgatagtggttaactgtatcatccttggccgtgcagagtcctatgcgtccaagaacgggcctgtcatatcaacatttgacggtatcggcatgggactgggctttaccatcgcccttacctgtatcggtgttgtccgtgaaatccttggttccggcgccgtgttcggcaacgtggtcatccctgaggattaccatatcgccatctttgtactggctcctggcgcattctttgtgctggcaatcctgacagcccttcagaacaagttcaaggcgccgtctgcaaccaacggttccgtgccacagtccaagctggcctgcggcggcaactgtatggaatgttccggttcctcctgcatgtccaaccatgaagtcctggagaccaggaagcgtcaggcagaggagaaggcactggaagccaggaaggcagccgtagctaagaaggaagcagagcttaagtcagctacttccaaaaaagagaattaggagggtggatagatgaaagaattattattaattgccattggttccgctctggtcaataacgttgttttgagccagttcttaggactttgtccatttctcggtgtttcaaagaaggtggagacctcagccggcatgggtgcggcggttatattcgtcattaccattgcatccgctgtgaccagcctggtttacaccggtatccttgtgaacctgcacctggaatatctgcagaccattgtattcatcctggtcattgcggccctggtccagttcgtggagatgttcttaaagaaatccatgccgtcactgtatgaggccctgggcgtgtacctgcctctgattaccaccaactgtgcggttctgggtgtggctcttaccaatgtgcagaagtcttataacttcgtacagagcgttgtaaacggtatcggtatctccgttggttttaccattgctattgtcatgttagctggtgtccgcgagaagattgagcataatgacgtaccatattccttccaggggtcacccattgttctgattacctcaggtcttatggcaatcgcatttttcggattttccggattaatttagaaggaggagaaggaaaatggtaacaggtattattatagcggcagcagtggtaggtatcctcggtatcctgattggtatcttcctgggcattgccagcgagaagttcaaagtagaagtagatgaaaaggaaatcctggtccgcaacgaactgcccggcaataactgcggcggctgcggctatgcgggatgtgacgccctggcaaaggccattgcggcaggccaggcagacgtaggcgcatgtccggtgggcggcgcttccacagcagaaaagattggggccatcatgggcgttgccggcggctctgctgagaagaaggttgcatttgtcaaatgtaaaggcacatgcgataagacaaaagtgcagtacaactactatggcgtggatgactgtaagaaagtatcggtggtgcctggggcaggtgagaaagcatgtacctacggatgtatggggtacggctcctgtgtaaaggcctgcgcctttgacgccatccatgtggtggacggcgtggcagtggttgacaaggagaagtgcgttgcctgcggcaagtgcgtgtcctcctgtcccaaccacctgattgagctggttccctacaaggcagggcatctggtacagtgcagttcccatgccaagggcaaggatgtgaagtccgtatgtgaatccggctgtatcggctgcaccctgtgtacaaagcagtgtgagtttgacgccatccatatggaggataacctggcagtgattgattatgagaaatgtaccaactgcggcaagtgcgcagagaagtgcccggttaaggtgattcagtaaggaatttaatatgcagtatgaaaggcggtctgccggtgtgataccggtggaccgcctttttgtatgggatgggattatggacatatctgattttatgtgctggcagaagcagcttttgctttgaccatacctaccatataatcactgatttctttaacagggacctggttatcagcctggaaatcaggttctgttttaagccactccatgaagccgctgcggttaaagacaaggcagtcttttggaacgctgagtatcagattatgacgggtaaatacagaggcggcatatatggggatgttttcataaggactatccataagggctgactccataagccttttttcctgttccatggaatcctctggattggggatttccttgatggattgattcatgtcctgcacccagcggaccggactgccttttgtatagacatgtccgccaaaaccataacagtggatcagaagcaggccaaaactgccggccaggatcatggtagttgggctgatggtgtctttatattggaagcttcctgggaaaatgattttcatcccatgtttgaaggcatggcttttcagctttaccagcagttcctcaatttcttttgaagtgccgttgtgggtatggaatggtttttgcttttcggataaatcctccggggcaatggtttccccgcaccttattttatggtagatttccttttttatcctccgcatgcggattaaccggggaaagataagtatacaggcaaagatgattagacagatggtaaggatatccccatttgtcagagtgttaagatagtccataagcaatcctccatgaaataaaaaaagatagaaaataatttgaaaatattatataatagatattgaaaaaatgcaaagaaaatgttattatgtaggcaactgatatatctgttgctttttctttttgtatgagcagacagaggaatatttttgttccagacttccgggaaacggtatatcagattgagggaaatggagaacgattttgggaaaaacagatagtgcatacgattatataaaagaaaagataataagtggcgaatatccgcctatgagtgatttgtccgaggataagcttcagaaggaactgaatatcagcaggaccccggtaagggaggcaatcctgcgcctggagaaagaggattttgtatatgtctatcccagaaaaggcaccatcataacagatgtcacacaggatttgatagaggatatttatcaggtccgccgcctgattgaacctgagatggttgtaagttccatgcatcagattgataagaactggctaagggatatgcggcgccgctttttggaaccggatccggacctaaagggggagcagcttagaagatactacatagacctggacacggagctgcacagctatatcatggcaggatgccccaaccgttatatgcgcaggatgatgaggaatatatatgaccagaaccagcgcctgaggattgcgtgttcccgcgccgatgccatggatgacaggaccacagaagaacatgtggcaatcctggatgcgcttttagagggggacagggaagaactggagaggacactggccatccatctggagcagtccaaggagaggacaatccgcagtttccgttaacccagtgccttaaaacacacttcaggataaagatgggacaaccatatcacttgggtagaaccgaaaggattatatccgggtgatatggtaaatatttatcatattagatatatcagttagatataatatatatattatataaatatcaataaaatataaggaggaactatggacacaaaaatcaagaaagcaaggatttaccgggccgtatccaagattacgaaacccattgctgattccacccacacaatcagtaagattgctttttatgtggcggaggtggagaccgcagacggagtgaagggacagggttatcttctttcgttccattactcaccaggcgccattgagggagcattaaaggactgctgcagcttcattcttgacagggaataccatgtataccagaccgtccttgccaaaaaagagtgggatatggaggcagagtattttggcaatacaggactgaatacctgtgcggttgccgcatttaacgttgcaatgtgggatgcatggggacattgcatcggacagcctgtccacaaactgctgggctgtaaccagaacagggttccggtatacggaagcggcggatggatcagttatacggatgaggaactgttggatgaggtgctggattacaagagccgtggatttaccgctgtcaaaattaaagtggggcatcctgacgggattgaacgggatctgcaccggttaagtatctgccgtgaaaggcttgggagccgtgtgaaaatcatgatggatgccaaccagggcatggatgtggtggacgcccttgaactgtcagagcaggcaaagggtatcggactccaatggtttgaagaacccgtaccccatacggactttgcaggatatgaactgctcaggcagaaatgcggcattgccctggccatgggggaacgtgagtatgactgtgaggcattgaaaaatctgattgcaagaaatgccctggacttatggcagcctgacctgatccgtttaggcggcgtggaagagtggcgcaattccgcggcattggcatccgcttaccagctgccggtacttccgcactattacaaggattatgatgttcccctgctgtgcactgttgcaaggccctatggcgcggaatcctttgactggattgacggaatcatcgacaataccatgcggattgaggacggatatgcttacccaagagaaggcgcaggctggggattcagatttaaagaagaagcattggaggaggttaggtagatgaaagcagtatatgtatcagagccaggtaaactggaagtaattgaaaaggaaatgccgcagatccagagcagtacacaggtgctggtgaagataaccgcggcaggtatctgcggaagtgacatacatattttccatggaacccatgcctatgccacctatccacgtatcatcggacatgagggatgcggcattgttgagaagacaggggatgatgtcacgggcttaaaagccggggatcctgtcatcattgaacccatacatggctgtaatacctgctatgcctgccgcaatggacggtataactgctgcccggatattgtggtagccggtgtccatgcagacggtgtgatggaagaatatatggtagttgaaagccggcagctttataaatatgacccggcgcttacacctgtccaggcagccacggcagagccatataccataggcgcccaggccaatgcccaggctggcaccatgccgggagatctggtgctggtccatggcgcaggacccattgggatgattatctgtgacatggcggagagccttggtgcaaccgtcattgtcagcgaggtaaatgaggcaaggcttgaaatcgcaaagaactttggtgcaaaacataccatcaatccaggccggcaggatttgagggaggctgtgatggatatcacggatggaaaaggcgtgaatgtggtatttgagacaagcggcgtcccggccctgaccagtctttcagtggaacttttgagtccccatggacgcctggtccctcttacgttcgcacccgagccggtacctattaatttcaggctggtaaacaagaatgagctgattattgcaggaacccgcaaccagaacagcaaatttaaagaggtggtggaaagccttccggggcgcagggacaggattgacaggcttgttacccatgtgtttcctgtggaggaagccaaaaaggcatttgaaacagccatggataaaaacagcggggcctgtaaggtgataattacgttttaggaggggatgaaatgacttcacaggaatatgttgcagatctgtttgatctgactggtcatgtgggcatcattaccggagccagccggggattagggctgggacaggcaaaggtactgacggatgcaggggccacagtgtataattttgacattgcgcctcattccaatgaggaaataatccgtgatggaagcctgattgatgtaatatgcgatgtgacggatcatgacaaagtaaaaagagaagtaggggaggttgcggcaaaagaagggcatcttgatttcctgataaacaatgctggaatcacatttaaatgcagggcagaggattttcctgaggagcggctggataaaattctcgatatcaacctgaagacacctctcatgatggccaaaatctgctatccgtatttaaaggaatcagagtatatcggacgggtcatctccatttcctccatggctgcatatatgggttttacagaggtacttccttatgatatgaccaaatcaggtatcctcggactaacccgggggctggcggaagagtggaaaaatgataatatattggttaacagtgtggcgccgggatggttcctgacaaaactgaatgaggggatgttcggacagaatcctgaccgcaaggcggcagcgctcagtaaacccatgcttcccaggttcggaaggccggtggagattggctatatgatgctgttccttttatccggagcatccacttatcttacgggccatgattttaccgtggatggcggggccacgtcccatggattttaatgcggaggaattataagatgaacacttccataacagcggttgagcgggccggatggagtacccctttggtcattcacggtaatttagaacatggtatcgcctgtgcgtcacagtggggatatgacggcattgaactgcatctgctggattcagatgcagtggataaaagggcgcttatcctatcgctgaaatcccatggcatttcccttacatccataggcactggtccgtcttacagccagcaggggatattcctgaccagtccgttttcggaaaaacgcaaggaggcagtgcggcgtatgacaggccatatccggtttggggcagaaaccggggcagtggtgattattggcctgataaagggtcagaaaaaggactgtgcggattcgggacactatatggattactttaatgacgggatggaagcctgtatcagggaggctggacggctgggggtgaacctggtgtttgaggtcattgaccgttttgaaagcgactggctgaatacggtggacgaggggctggggctgctgcatgcccttggctcagataaccttttgctgcaccttgatacattccacatgaacatagaggaacctgactgcgcggacagtatccgcagggcgggagggaaggttgggcatatacatgtagcggacagcgacagatggtatccgggtcatgcccattatgattttgaatccacgttccgggcattgcaggagattggatacaggggagcagtggccctggagtcgtttcagtaccctgatccggaaacagcagccaggcgttccctggaggtgattaagcccttatgccagtgaatccatgaaggatacagaaaaaacgaaaaattggaagaataatacaagaatacggggattgacagatgaaatgtgtgaaataattaacgttttccggctgacaaattaaaattattaaaaagttagataaaaactattgattttattgtgatatatatgtataatatcacatataaaaagtgtgatatatcaatagtatttaagttttatatcactgcatcatctaaaaaaggagagcaaatatgaaaaaagtattgggaatttcaatggcgcttatttcagcagtttcactgacagcatgcggcgggggagcggcagctacgacagcagcaacaacggcagcaccttcaggtactcagggacagggcgcaggtgaaggggcatccggcagctgggataattacgaactgaagctggccacgaatctggctgaggaccatgtggcctgtaaggggtattatgcatttgcagatgcagtggaaaaagcaacggatggacatgtaaaggtgactgtttattcaggagagcagctgggtaaggaaagcgatgtgacttcctccatttccatgggagcaggtacctgtgattttacaatgtgcggaccgtccgaactgtccaaatatgaccctgcgttttcactgtttgacgccccctatgtattcaatgacggggatgccatgactgcttttgccaatagtgatgaagtacagaagctttatgatggtttggcagagtccagtaacctgagggtgttaggcatgtattattatggctccagggaggtgactgtcaaagggttccctgccacagaaccatctggtttaaagggatgcaaacttcgtgtgccggactcagagatggccatggcatatggcgctgccttaggggcaacccctactgtcatgtctcttggcgaggtgtatatgggcatccagcagggcgttgtcgatggacaggagaacccgcttccaaccattgatgccaatgcgttttacgaagtgtgcgataatctgctgatgaccgaccatgtcattgcagccgtcacctatacaatggatgaaaaggtatggcagagtatgccggcagacctgcaggaaatcgtgcagaactgtgtatacgagagctgtgaatccattacccaggcaattgaggaccaggaagccggcctggtagacacgatgaaagagaagggcatgaacgtaattgaggttaacaaggatgcgttcaaggaaaatgtccagggtatttatgagaaatatgccgatacctggggtgattggctggcagttgcacaatcctataacaagtaatagcggataaatgatggcagattcccccggttattgtaacggatacgataattgggggaattacatatcaggaaaatgtgtcaggaggatataagttgaaagcaataatgaaccgaattaacaggatttatgacaaatttaacaagatgaatgagtattttatcatcgggctgatggctgccatgtgtctggtcctgctggcccaggtcatatccagatatatttttgggaagccgctgacctggtccgaggaactggcaagatatatgtttgtatggctggctttgctaggttccgcatggtgtggcagaggacatatccatgtacgcatgactgccctggtaaaccgttttccggcgcctgtaatccatggattgcagattgccatcagcctgttgatttccattacctgcttctatctgtttccgcatgcctgtgagatattcatgaagcagagtaaactgaaagcagttacactgggggtcagtttggggattgagtatatagcggcaccagtaggaatcctgatgatagccatacaatggtttgtggacttcctttttgccgctttggactgggaaggctatcaggcccgttatatgaaacaggaaggagagtaggagatggctgtattactgataagtttcttggtgctgatgatattgggatgcccgattgcattctgtcttctgtgcagcggtactttatattttgtaaccaatgacatggcgttaatcatgctggtgcagcgccttaccgaaggcgccaatacctttacccttctggcagtgcctggctttatcctggcgggcaacctgatgaacagcggcgaggtgacagaccgcatctttgacttctgtgggaagctggtggggcatattacaggaggcctggcccatgccaacatcctggcatccgttgttttcgcaggaatgtccggggcggcgattgcagatgcgggcggccttggggccattgaactgaaagccatgcatgacgctggttacgacgatgatttttcacttgcggttacgggggcttcctcgctggttgggccaatcatcccgcccagtgttccagcggttgtatacggtacggttgcatctgtttctattggacggctgtttatagcaggggctgtcccgggagccatcatggctacggccatgtgtatcatggtatatcttataagcaggaaacggggctatgagaaagaaggatggtgcgggttccgcgctcttttacactccttcagaagggcatttctgtccctgctgactgtggtggtcatcctgggcggtatccttgcaggtatcttcacacccaccgaggcggccatgattgcaaccttctatgcaattttcctgggattcttctaccatacgctgacacctaaaaaactggtgctggcccttaaggaggcaagcgagacaacctgcacggtcatgatgattgtgtgcggggcaacgattttctgctggatcctttcttttgaacggtttccccagtttgtggccaacctgttccttatgtactgtaacaacaaatacatcgcattactgttaatcaatatgttcctggtatttgtggggatgtttatggattccaccccgtccatcatcatcctgactccggtattcctgccggttgtcacggccatgggcgtggacccggtccattttggcattatcatgatactgaatctgatgataggccttctgacacctccggtaggcatggtgctgtatgttttgtccaaggtatccagtgttccctttgaacgcatatgcaaggctacggttccatttatcatcatgttctatatcctgctgcagttcattacatatattccgcagatatcgcttatgctgccgtccctgatgtatggagcgggatgatgtacatgatgggagggcaggaaggatggaggacaataagcttttgctgatacatccggatgacaatgtggccatagcgctgaccaggctgaaaggcgccggggtttaccgggcagggaacatgcaggtcaggattacagaggatatagaagcggcgcacaaagttgctttaaaacggattgaaaaaggagggcaggtcatcaagtacggtctgcccataggaaaggcagccagggagatacagccgggggaacatgtccatatacacaatgtggttacaaatctggatggcctgattgattatgagtacaggccgctccccaatgtctggtccgccttttgtccgcaggaagaggcctggtttgacggttacctgagggaagacggaagggccggtacaagaaatgaaatctggatcatacccacagtcgggtgcgtgaaccgcacggttcgcatccttgcccggaaggcggaagaacggtatgggggcatggtggacggaatacaggccctgacacataatgcggggtgcagccagctgggggaggatatgctgattacccagaagctgttaaagggcctgatttgccatccgaacgcaggggcagtcctggtggtcagcctgggctgtgagaataactgcctggagtattttaaacccgtattaggtgaagtggatcctgacagggtaaagttcctggtgacccaggattgcggtgacgaatatgctgagggaatgaggcttttggatgagttggccggatatgccgctggattcagacgtcagagactcagtgcgtcccttttacagattggcttaaaatgtggcagctccgacgcattttcaggggtgtcggccaatccgctctgcgggaggattactgacaggctggtacggtgtggaggcaaggccatactgacggaagtatcggagatgtttggggcggaggcccgtctgatggaacgggcggaggacaaggaagtattccaggaaatagtgggccttataaacaatttcaaagaatacttcatgcgttacggacagcccatagacaggaacccatgtccgggtaatatacgcagcgggatatccacggatgaggataagtccctgggtaatatccaaaagggagggtctgcacctgtggtggatgtgctgtactatggtgaccaggtatgcagggcagggctgagccttctgaccggaagcgggaatgacgcggtttccgttaccaacctcacggccagcggtgcaaatctggtgttgtttaccaccggaaacggcaatccctttggcgcggtggtgccgaccattaaaatatcctcaaacacggcgctttcgcataaaaagccggattggattgatttcaatgggggacaggtgttggacggacttggattggaagagaccgcagaggagctgtttggctttatgctggaagtggccagcggtaatcggcagacaaaaaatgagcaatatggatatcaggagatatctattttcagggatggggtaaccctgtaaaagcaggacataaattgattggaggaatagattgatatgaaattcagcgcaaccgttacattacaatatgatactatattttcatccttctcccatgaggattacctgaaagggctggattggatgcagcagagccgcctggacggcgcagagctgtgtatcagcagctattcggatattgacctggggaaggtgaaggcagaactggatgagagggggttgggctgttccaccctttccacaggccaggccagggggcttgagggcctttccctgatcggggttcccgcggatatcacgaagaagacccaggaacggttcatgcagcacattgacgcggctaagatcctgggcagcaaggttaccatagggctgatgcgggggctggggtcactggaaaccatggataaggatctgggggatttaagcgaggccatgaagccgcttatttcatatgcagaccagaagggggtcaccctctgcctggaggcaattaaccgctatgaaacagccctccttaattcggcagaagccaccatggattttattgtgaatgaccttggcaatccagattgtgtaggcatcctatgggatctgttccacgccaatattgaggatatcggatttaagcgaagcattgatattatgggaaataagctgcagcatgtgcacctggctgattccaaccggatgttcccgggctatggacatactgattttgcagccatattgaaggcagttaaggattccggatattcccagtactgttcctttgagtgcctgaaccagccttctgcggatatcatattgaaggatacggcggcctgggtacagtccatgagggagctgtaaaggcagggaggttaagatggatgtattggaacggattttagagaagaagataattgccatcatacgtggccttaaactggaggagacacttaagacagcggatgcggcagcggcaggcggcctgagtcttgtggaagttccatttgaccagagacaacccctggcatataccacagataaaataaaggcggttgctgacagatacccggatggccgggtgctggttggggccgggaccgtactcaccatccagcaggtacaggcggctaaggcggcaggcgcaggatatatcatcacccccacttcccgtgaggatgtgataaaagagacaaaggccctgggaatggtggcaatgccgggagccatgacacccagtgaaatcgaacagtgttacaggtggggagccgatattgtaaaagttttcccctccgataatctgggtgccggttatatcaaggcactgcagggaccattgtcatacatacccatggcagcggtgggaggtgtggacctggataatatacttgacttttttgatgccggtgtatgcgctgtgggaatcggcgggaatatagtgaaccggaagatgatagaaacaggggattacaagggaattgaaaaccttgccgcggaatatacagcaaaaatcagataaaaggacagaaaaccatatgtatattgtttattatgactcaggaacaaccaatacccgggcttatctgataaaagatggtatgattacagcgcggctggagcggcagatcggcgcaaggaattccgctcttatgcaggataattcagtgttggtcagggaactgcggaacatgcttgatgtcctgatggaggattcccatatacataatgaagatattgcccacatatatctgtccggaatgatttcctgcccgtcggggctggtggaaattgagcatctccctgttccggtggattggaaaaaactgcgggattcaattgtctgttatgaggaggaacggttctttaaaagaacgcttgaaatcatccctggtatcaaaaccgttccttataatgcacaggtcattccggaaaccgcggacagggtcaacatgatgcgcggggaagaaattgaggtatttggggtactgcgtgggaatcatgacctggaacagggaacagctgtcctgatactgccaggaagccatacccaggccgtactgctggaggatggatgtataaaggatatatcttccaatatcacaggtgaattattcaaggcggttgtctgcgagactattttgggggcaagtattaccggggaagaggaatgggagatagatgaagggatggtatgtctgggggctttcaatgcgcatctccatggattcaaccgggcattgtatatccttcgcattttagatctgttcacagaagcttccctgaaccagagacgctcttacctggaaggcgtattgaatacaggggtaatggatgcggtaacggaagcctttggctttaaagaaatcaggaatcataggggacaggatggcagacctgtaatcaggctggcagttgccggggacaggattcagcaaaagatataccatggactttgcctgaaggaatatcccggattcaatatgattccggtcagcccggttagggatatgccgttctctgtcagtgggcttctacgcattgcgggaatcggggacacgaattaaatcagtaaatctcagaagtatcatattggaaagggcgatatggaataagcctggcaattaacgcgtctgaatgcgtattgccaggcttattccatcggtatatcttaacgttttttcttctttttctggaaagccggggagtcaaaggacctgtcatcgggcagcaccttgcggcttgtggcctccaccagatcgtcataacatgcaaatatcttatccacatgtgcaggctccatccccggggtgagtagcgacacgattgggacaatgatgagtccggctaccatggcaaatgcacctgcgttgatgggggattcaatataatgaaggaacatattggataccgtgatacccacaccggctgcaaagctggcccacacagcggccggggtcacctttttccagtacaggccgtacaggaatggcgccaggaatgcgccggccagcgcgccccaggaaatccccataagctgtgcgatgaaatcaggcgggtccagtgccaggacaacgctgctgatgatgaagaccacaatcagggcctgcatcaggatgagctgggtcctgtccttcatgtcctttaccaggtttcctttgatgaaatccagggtgagggtggagctggaggtgagtaccagggaggacagggtggacatggaggcggacagcaccagcattaccacaatgccaataaggatatctggcaggccggaaagcatggccgggatgatggtgtcgtaggcaatgcccccattaccgttgtagatggccggaccgtcaaagagacggccgaatcctcccaggaaatagcttcccccggatatgacgatggcgaatatggtggaaatgaccgtgccggtcgcaattgccttttcactgcgtatggtatagaacttgtggatcatctgcggcagtccccaggtgcccagggaagtcaggatgacgacacccagaaggttcatggggtcaggcccgaaaaaggaggtataggcgccgggctgtcccattgtgagaggcacctcgcttggaatcctggccagattgccgacagcggccgtaaaccctccctggccgcttaacacgctgaggatgacggcagtaatcccggccagcatgatgataccctggatgaagtcattgatggcagtggccatatagccgcccaggatgacatacacggcggtcaggaccgccatgcccagcacacagacgccgtaggggatatcaaaggccatgccgaagaggcgggacaggccattgtatacggaagcagtatagggaatcaggaacacgaaaatgattacagaggccacaatcttaagccaccggctgttaaaacggcttccgaaaaattcgggcatggttgcggaggacaggtgtttactcatgacccgggtgcgccgtcccagtacgacccatgcaagaaggcttccgataagggcgttgccaatcccaatccatgtggaggccaggccgtatttccatccgaactgtccggcataaccgatgaagacaaccgcggaaaaataggatgtgccgtaggcaaaagcggtaagccatggcccaacccccctgccgccaaggacaaaatcattgacattggtggcatgacgcctggaatagaacccgactccaatcataatggaaaagaagatgatcagcatcagcagtttgattgtcattttattaacctccgggagtattttattattactttactaattaaaacttctgaactttaatgtatcagagcaaaggcggaaagtcaaagagatttttgctgttttccattctttggttgaaatgcacatataaggatgggatgatttgcacttaaaacaggtttttttagccaaagtgggggaaggacgctataattcgacaaaaaatatgcttcaatgtgcttgtgtattaaaataaataatggtataaaaagttaaatataagtaaaaaataatttacataacacaaattacaaaaaaaggaaaagaaagtatgtgtttaaaaattaataataatgtaacataaatgtaaaaataaaaaggtcaaattatacaattatgtaattaaaaccactggaaaaatataactaatatataaaaataattacaaatatttcaaatataataaaaaatgtaacaaagatgttaaatctccattgacggcaaaagttaaatcccatataattagccatacatcccggaaaaacatgcacaaagtggggattgacccactggaacaaaaacaagaattgggctccggcatgttgagataggggagtccaggaaagaggagtatgtatgcttacattacattcattccttcagtcggttgtcctctttgttaaatcacttacagtgaaagtcacaaagcagatgtaccgatcctcgtcagtcctgctgaccggcatgatggttgttgccatcattgcattttcagccgaagggtttggcggcgggggcaagaatgccctggcagcgcccattgcggatgaaagtcaggaggaggtacagacagaggaacctgagggaagcggtctggttacggaagcaaaagtacaattcggacttttagatactgacagcgaaggccaacaactggctggtgcgctgttagaagcaaatgtccgtgaaaagcagagacagcaggcagctgcacagacccagattgagacacttcagaaacagatattaaaagagaaacaggaagaggaagcaaggaagaaagctgaggaagagcgcagggcatccagaaggatccgctatacggatgaggattaccaggtccttttacgtattgtccaggcagaggcaggcatctgtgataagagaggcaagatacttgtggcggatgtgatcattaaccgtgtattgtcaaaggaattcccaaacagtgtaaaggcagttgtatacgagccatcccagtttcagcccgtttccaacggcgccattaactctgtgaaggtcacggccgagacaatcgagtgcgtggaccgcgccctggatggagaggattattccaacggtgcgctgtatttcatgaaccggagaggttccggcagcgcggcggcctggtttgacaggcaccttacctatctttttgcccatgacggccatgaattcttccgatagtggagggacagggaccggataaaaaaatgattgagtttcccatggctttaggtgtatacttgtaatggaaaataatcacacaaaggagaatgggatatgatatttgatgagaaaaaaaatcttgatttttacagaagcctgggcgtggacggcaggtatgcaaaagcagtggatttcctgcagaatacggacctgagcgcattggagccgggcaagtatgagattgacggcaagaatgtttatgccaatgtaacggcttataccaccattccatgggaagaggcaaagtatgaggcacatgagcattatacggatatccagtatgtgattgagggaagtgaggtcatgacctatgcacctgtccatgagatgacggtgaagaccccatataatcctgacaaggatgttgtgttttttgagaataccaccccagggcttcagattgtgacaaaggctgaccagtacctgatcttcaatccatgggatgcccataagccaaaggcagctgacaaggagccggcgccaattaagaaagtgattgtgaaaatcaaggaagattaatccgtttcagcggacccggcgccacgggggattgtacccggcggtaccggccatgcccggcagtgtgaaagctgccgggcttttatgattgccaggcattggcccgggttaatatttccctgtggaccatcctgtaaaacaggggttgttacaggcgggtttctggcgtatactctatagaaagaacacatgactttcatgggcggaggtaaccatatgcagctcacctatctacatatacgcaatttcaaatccatccgcgacctggaaatccgcgatattgacagggcgctgatcctggttgggaaaaacaacacagggaaaacatcggtgctggacgcggtatgtgctgtgtgcggctgctatgaaatccaggaagaggactttaatgagaaacggcaggccatccgcattgacgctgcgttccgcattgaggaggaagacctcaggctgttccaccgcagggggcttgtgagccagtaccggcgttttgatgtgtggaggcgcgtgtttggggaacggcttccctcctttaaggatggagggctgtccttcacgttccacgtgaacctggacggcagggtgcgctatgaggatccctacaggaagaataacccatacattcccatggtattgccccatatttaccggattacggcggaccgggaattaaggcagctgcagaacgacctgctgatgttccaggaggatgaggaattaagccgtctgcggtccggaagatgtatctttgaggcatctaaaacatgcaaccactgtttccagtgtatcggcctgattaataagaaaaagccggaggagctgactgcctttgagacggcccgcctgctggaacataagatctaccagctgaacctcagcggcttctcccggaaggtgaatgagaatttcttcaagaacggaggctatgaggaaattcagtacactttaaactgtgacatagaccagatgttttccgttgaggtgacggcccacaaccggcagcggggcagtgtgaagccggtggaacttatgggcaagggcatgaggagcatctacatgctttccctcctggaaacctatatcagcgaacagagccgcattcccagcatcatcgtggtggaggaccctgagattttcctgcatccccagctccagaagtcctgcagcgagatattataccgtctgtcaaagaaaaaccaggtcatctttaagacacacagcccggacctgctgtttaatttcagcatccgccagatacgccaggtggtgctggacggggagaggtattccgttatccgggaaaggacagacctgggccagatactggatgaccttgggtacggggccaatgacctgttaaatgtaagctttgtgttcatcgtggaaggaaagcaggacaaaagccgcctgcccttgcttctggaaaagtattattccgagatatacgatgataagggcaacctgaccaggatatccatcatcacaaccaacagctgtaccaacatcaagacatatgccaatttaaagtatatgaaccaggtctatctgcgggaccagttcctgatgatacgggatggggacggcaaggatccggaagaacttgcatcccagctgtgcaggtattatgatgagcggagtctggaggatgcggaccgcctgcccaaggtcacaaggcgtaacgtgctcatattaaaatattattcctttgagaattacttcttcaatccgtccattatggcaaagctgggcattgtggatagcgaggacgcattctatgacacgctctatgataagtggcatgaatacctctaccgtatccgcagcggccagcagcttatggaggtcatgggacgggatttcacttcgccggaagacatgaaggcacatatggaagaaatcctcacctatatgaggggccacaatctctatgacctgttctacggccctttccgcgacagggagcaggagatattgaaagcatatattgatatggccccaagggaggagtttaaggatatactggatgcaattgaccggtttgtgtattttgacagcaggaagaaggggtgaggacacggcccggcgggcatggggtggatgcggggatatatccgggaagcgggccggggcgggtggcggcctggatacatggcggcttggatacatggtctaggagggagcagctttaaaggttctgataaccttaagaagctgctccctcctttttatcctatatttaattggccggttacacggaatatgcctcttcggctgtgtcggcttctgcatttttgcctttgcccaggacacaggtgaagacgaaggtgccgaggcagacagccgcgaatatgattcctgccgggtatgcaaaggatgtggggagctggaagccttccttggcaatcaggatgtatgtacaggatacggctgacatgaaggttgcgggaagggccgtaagccagtaaaagcgttttttgcggaacaggtatacgcttgcggaccacagtgcaatcatggccagggtctggttgctccaggagaagtatctccagattatctgcacatcaatctgggtcagtacggaaccgactgccagcaggggaactgtgagcatcagacggttcttgatgggcttctggtcaaacttgaaccagtctgccagagtgagccttgcgcttctgtatgcggtatcggcggaagagatgggacatgcgataacgccgatcatggcgattactgcgccgacaggccctaaaagggtgaagcagatttcgtatacaacgctggactgtccgttgccaagggctgtcagaagtccgcctgtgccgttatagaatgcaacgcctgcagctgcccagataagggcaatgatgccttctgccaccatggctccgtagaacaccctgcggccgtccttttcattggtaaggcagcgggccatgagcggggactgggttgcgtggaatccggatattgcgccgcaggcaacggagatgaacatggttggccagatgggcgtattggccggatgcaggttttccagtgtgatttcaggtatatggtatccgcctaacaggatggctccgccgactccaagggccatgataatcaggcatataccaaagaacgggtaaaccttgccgattaatttgtcaatggggacaaaggtggcgatgaagtagtaaatcagtacaacggccagccagaacctggtatccaggacattgggtgtgagcatggccagaagattggctggtccggtggagaagctgacgcctaccaggaccaggagcacaacggagaacacacgcatgacctgtttcatggcacttccgagatatgtcccggtaagctcggaaacactggcccctttgtggcgcatggacatcatgcccaccatgtaatcgtggacaccgccgcccagtaaggttccgaaggtaatccacaggaatacgctgggtccccagcacgcgcctgccagcgcgccgaagatgggtccgaggccggcgatgttgagcagctggattaagaagatacgcggagtgcccattgggacgtaatcacttccatccgtcatggtaagcgcaggcgtcttcctgtcgtcagggccaaaaaccttttccgcaatcttgctgtacactgtgaatcccccgattaatagtgccagacatacaaagaaactaatcataaacctacctcctgttttgtattaatgaattcatctgtatgcacttattgtactaaaaagccgttaaaaagaaagactttttgtgtaaaatgcattactggatgcacaaacggtaggaaaatgttcattaacaggcactggaatccacggctgacggggtgtgattttcaaacgcaccctgggcgcaggatagggcggctggcaggaaatcatatgcccaacagctggcgcaggctttttaccttctcccttccaacgggcaggatttctttttcaaagccctgcatctttacagccaggctgttgttggcccagggaaacatttccgtgatatatcccaggtttacaaggtaacttttgtggatgcggaaaaaaccgtggggcgccagccgtttttcatattcccccagcagctggttttccgtatagtccctggtggcggtatggatgatgcagcttctgccggaggtctcaatgtagacaatctgtggtatgtccagcattacgatggtacggttcacattgattgccatcctggcggagggcgggacaggggctgcaggctggctggcggatggtccgggtccgggtacaggtgcagggctggctttggactggtttaaatcgtggcagcatttttccagtaccctgcggacacggtccgggtcaaagggttttaatatgtaattgttgacacccagttcaaaggccttgaccgcgtactgggagtaggcggtggcaaacacaatctgggcgtccggcaggatacgtctggccgcagcggccagggtggttccttccatatcattgagattgatatccacgaacagcaggtcaaaaggctggctgctgataagctccagggcattggaaccgctgtcagcctcctcgatatggctgtccggcatggcagacaggatctggtggatcagttctttcctcgacggcctctcgtcgtcaatcacagcaatcttcattatgggaaatcccccttattcagcaattttccttgtcttttcccgtggtgcggggcacacggaaccataccctggaaccggcggacgatgtctctatcttcagtccgttatcctcgccgtatatgctctttaggcggcggtgcacattctttaagcccacaccgcccctgccctcgccggaatacatctggatgatgatgtccttggggattcccggccccttgtcggagacggagatttccacggaatcatcgatggtgcgggcctgtatggaaaccgtgcgcatgcccttggcatcagcgccgtaacgcaccgcgttttcgaccaggggctggaggatgaaggatggcaccaggcagtttaagtcgtcttccacatccatgtctacctgtaacttttcctcaaaacgggcctgttccagttccaggtagctggacacatggtacagctcggtgtgcaggttcagcatgtactggtcgttctcaagggtctggcggtagtaggcggaaagggtgagtatcagttccctggcccggtccgggttttccctgcacacgcacgatatggtgtttaatgcgttgtaaaggaaatgcgggttgacctgggactgcagggctttgaactccgccttgcggcgcagctgtttctggtagtccaggtcggaaagttccagctgggtggagaaaagcctggccagttcggatgcaaagttcaggttgggctgggaagtgacccagtgtttcctgaccaccatggtcaggctgccgatgggtttgtccatctctatcagaggcgctgtcacgatgatgtggtttttcagtatgtggtacagcgggtccggcttctcggcacaggtgaaggtggtggtcttacggtcatggatggattccaggatgggctttaggagggccccgccttttaaatcgttgtatctggcttcccctttcatggccagtaccttctgggtatctgttatcatcacggctgcgcaggaggtggaattgtagatgatctcagcggcagcttccatatccgttgtgctgtaaagccctttcctcagatggggaaggctctgctccacgattcccagggccagccgcatcttctccgcaaactggctgtcctcctccatgaacacgatgctgaaggtgccgatgaaggcaaccatgcccaaggcgttcatggttatcatgggaaatgcaatcagccccaccagctccagggccgctggaaatggttttgagatgaacaggatgatgaccatctggcagacctctgccagggccgtgataaggaagattccggcgttgtcaatcttgcctgctttaaagcgccgggaaaatgcagaaccgatcagcccttccacaaaggtggatatggcgcaggaaacagcggtgaagcccccgatatcaaacaggtagcggtgcaggccgccgatgatggcagcccccatcccgacataggggccgcctaacagtcctgctgccaggacgccgattacacgtgtgtttacaatggcaccctgggcccgcatccctgtataggtggaaacaatactgacaagtccgaagatgactgcaagggccgcacggctgccgatgggattgttttcacccagcagcatgctgcggacaacgggaatcttggtcagcatggtggcgatgagaaccagcagccctatatttagaagcaggctgaaaaacatggtgttggacatggcagtcctccttggtggaattgttttattactgaatgtagtataagtataccaaatatttgcagaacagggaatcttaagaaaatcttttattgtatttcatcttaaggtatgctaatctatgttcaagggcaactgtactaatataattaatacagtcaacacaatgatatttcagaaagggggaaggaagggatgattgtactggattacagggaccggagacctttatatgaacaggtggcggagcgcctgcaggagatgatgtttaacggagtgcttccgcaggatacgcagcttccgtccgtgcgcagcctggccacagacctgtccattaatcccaacacaatccagcgggcctacggcgagctggaacgtcagggatatatttactcagttaagggaaagggaagctttgtggctgacagcagccgcatgagggccgggaagctgaaggagtggaagggccgttttactgcttccgtggaagagggcatgaagatcggcgttacggcagaggatatgacagggcttatggaagagacattccgtgggcatatgacagaaaggggagatgggcatgattgaggcagtgaacctgaccaaacggttcgatgatatagtggcggttgaccatataagcgccaccataaaggatggaagtgtttttggcctgatcggcaccaatggggccggcaaatccacgttcctcaggctggccagcggtgtgctgaaaccggacgagggatgtatcaccatagacggacatgaggtgtttgagaatacgcctgcgaaaaggcggttcttctatatctcagatgaacagtattttttcaacaactcaacgcctttggagatgatgcattattacaggcatgtatatgagggatttaatgaggagcggttccacaagcttatgaagaacttcgggctggatgagaagcgcaggatccatacattttccaagggaatgaagaagcaggtatcggttatctgcggcgtgtgtgcgtccacggactatctgttctgcgacgagacctttgacggcctggaccccgtcatgcgccagaccgtgaagagtatatttgcagcggatatggaggacaggaacctgacccccatcatcgcatcccataacctgagggaactggaggatatctgcgaccatgtggggcttctgcacaagggaggtatccttctgtcaaaagacctggatgacatgaagcttaacatccataaggtccagtgcgtgctccagcccggcatgaagcccgaggacctggtggcccttgataaggtggggattgagcagcgcggaaggctgtgcacggtgactgtccgcggcagcaggcaggaggtggaggccatcctatcctcctatgacccggtgttctatgagtgcattcctctgtccctggaggagatatttatcagtgaaacggaggtggctggttatgacatcaggaaacttgttctctaagcttatgagggaggactgcaagcggcgcacatgggcctttgccctggtctttttggcttttttcttcatccttcccataggcctggcccttgccatggaggatgcggccaatacacagtattatgtatataacggctacagggattttgtacaggacccgtccatgccgctggctgtctaccaggaaaagcttctggaactgaagacaaaggtggttttaagccaggcggaattcggaaacggcatggtggtattccttatgatggctgcagcggttgtcatgggggtatccagcttttcttatctgcataacaggaaaaaggttgatttttaccacagtatcccggtaaggagggaactgatttacagtgcgcggtacgtgggaggcatcctcattgtaggcatttcctatctcataaacctgattcttatgtacggggttgccctttcttacggtgtgggcaccgcaggtatagccggcgcaatggccggaggcctggcattgaacatgctgtttttcctgctgatgtacgcagcagtggtgatagccatgatgatgacaggtaatatggtggttgggatcctggcatccggtgtgttctttttcttctttcccgcagtgatgctggtgctggaagggtactgcgatatctttttcgtgacaacagccaggaatgcatggacctccgatggctcgccgtttatgtggggaatgaaatacctgtccccattcagcgtctatctgacagcccttgactggcggctggacgaaatcgtaaagcatgtgccggagcttatctgttccggattcggcgtcctggcgcttttcttcctgggcctgcagctctaccgcatcaggccttcggaggcagccgggaaggccatggcctttaagcgcaccatggcgcccatccgtatccttcttgtgctggggtgcggccttgccggaggactgtttttctgggccatgcagagcaagctgcgctggggtctgttcggcaccattgtattcataatccttacccactgcattgtggaaatcatctataattttgattttaagaaactgcttggcagtaagctgcagctggcgctctgccttgcggccggcgtccttgtgttcctgagtttccgttatgactggtatggatatgactcctaccttcctgatacggataaggtggtgtctgccagcctggatctggatatagacagcggctggctgaataaccagtttgtaagccgggatgaccagggggaatatgtgctggattataaacaggcctatgaaaacattgaaaaggatatgaagcttacggatatggacctggtcatgcccctggtggaagagggaagacgcagcacccttcttaacagggatgaacggctggggattgtcaaaccagtcacccaggtgcggaatgtatcttatatcgggggagcagacggacccacctctattttcatagcgggaaagaccggaggggaagacggcccgtctgatacgggaatcaaggcgtaccatacgggcatgaccgtatgctatcagatgggcaatgggcgcagtgtaaggcgttcctatcagattgccctctcagatgtgatggatgtttacggacagctgtacaaggaggctgcttataaagaagggctttaccctgtgtttcatgaaacgccgggaaatctggtaaaggtaatctaccgggaaggggggatgtccgcctataccggagaggacagcaggacgattgaaaaactgctggttgcctaccagactgacttcatggccctggatacacagacacggattaaagaggctcctgtgggcgccatttcatttgtgacgaaggaggcccgggattacatggaccggaacctgaagcagatgcgctccggcggaaggggcggctactgggacatgagtatggaggatttcatccagtactggccggtatacccatcctttacccatacccttcagatcctggaaggagagggcgctgagccgggaaaacattttgctgccgacaataccagatcggtcaccatcaatgtacagtcccttttctacaatcgggattccggcagcgggcttccccaggacgatgaactggccgatttacagaggaagaatccctattatacagaagaagggaatctggtgattacggatccggctgggatagcgcagcttatgggggctgtgatggaagatgaattccaatcaatggaccagttccatcaggtttcaggggctgtctcctactgtgatgtggaattggaaggcaatatccatgtttcgggcatcctgctgttagacaggatgacgcctgggatgctgggaatctttgaaggacttcctctggagaatatcctttaaggatgaaggaagatgcaccggtgcttatgaagcctgcttcatgggatccggtgcatttttcggtttccatgttttcggtttcccatctgtcttcatggacgcaggcctgtcctggccgtacaggaccatctgtcccatgtagggcatgtagggctttccgtttctttttattgacaatccatccatggaaagctacaatcatatcaacagatgggaaggctccaaaaaacgcgcctgccccaagggagaaagagaggacataagtatgatatcagagaaaatgaaaccattggtaaataataattccgcaatccgggccatgtttgaagagggcaaaaagctggcggccctatacggcgcggagaacgtatatgactttagtctcggcaaccccaatgtgcctgcgccggattccgtaggacaggcaatctgtgatatcctgaaagaagaggagtctacttttgtccatggatatatgagcaatgccggttatgaggatgtaagggatacaattgcacagtccctgaaccgccggttcggcacatctttccaccagaataatatacttatgaccgtgggcgctgccagcggactgaatatcatcctcaagaccctcctgaatccgggggatgaggtcattgcatttgctccttactttgtggaatatggcagctatgtgcgcaactatgacggcaatctggtggtcatttcccctaacacaaaggatttccagccaaaccttgacgaattcggggagaagattaccccaaggacaaaggcggtcatcatcaatacccccaataaccccaccggagtcgtgtattccgcagggaccctgtccaggatggcggatatcctgagggagaagcagtcccagctggggacggatattgtattgatttcagatgaaccgtaccgcgagctggcttatgacggcgtggaggtgccttatgtgacagggttttatgataacaccgtcatctgctattcctacagcaagtccctgtcccttccgggcgagcgtatcggctacctggtgataccggacgcccttaaggacagcgaagaggtgtttaacgccgcaaccattgccaaccgtgtcatgggcgcagtgaacgcgccgtcactgatgcagcgcgtcatcaaacggtgcgtggacgagaaggtgaacctggaagcatatgaccggaaccggaacctgctgtacaatggcttaagggacctgggatttgagtgtatcaagccagagggcgcgttctacctcttcgtaaaatcaccggaagcagatgaaaagcagttctgcgccaactgcaagaagtataacctgctggtggttccgggcagttcctttgcatgcccgggatatgtaaggatttcatactgcgtgtcctatgggcagattgaacgttcacttcctgcattcaggaaagtggcgtctgattacggtctggtataggataaggacagccggcaagggatgaaaaacggctgatgaagtaaagtatatgaggtcagaggaaagggaggaatccagagtatgagaccatgggaagcaaatatacgccaggtagtgccttatgtgccgggggaccagccgggcggtgatagactgataaaactgaacaccaacgagaatccgtatcctccgtccccgggagccattaaggccctcagggaactggagacggaccgtctgcgcaaatatcctgacccggcggcttccatgctggtggaggccctggccggatattacggggtagaggcggaccaggtgtttgtgggggttgggtctgatgacgtgatagccatgtccttcctcacgttttttaattcggataagccggtgatgtttcctgacatcacctattcattctacaaggtgtgggcggacctgtaccggattccatatgagacgcctgccctggatggggattttaatatcatcccggaggattatgaaaaggaaaacgggggagtcattttcccgaaccccaatgcgcctaccggtatctatatgcctcttgaacaggtggaagggatcataaaggccaaccaggacgtggtggtgatcgtggacgaggcatacattgattttgcagggaggtccgcgctggaactgattggacggtacgagaaccttctggtagtacagaccttcagcaagtcccgttccatggcgggcatgaggatcggctttgccattgggaaccggcgcctgatcaaggcccttaatgatgtgaagtactcctataactcctataccatgaatctggcctccattgtgatgggcacggagtcggtgagggataaggcatattttaaggagacaacggacaagataatagctaccagggaacgggcaaagaagcggcttagcgggctaggattcacctatccggattcccaggccaatttcatctttgcgtcccatccccgcgtgcctgcatataagctttttgaggcgcttaagcaggagcagatttacgtgcggtatttcggcggggagaggctgtgtgacagccttcgtatcagcatagggtcggatgaggagatggaggagctgtttgcattcctggagcggtatctgaaggatttttcataaaagacaggatgggtgatatgtatggaagaagcagggtggagacattatctgagactcgtgcttaatattgtaatcccgctgacaggatggattctcctgtgttttctgggaccaaagatcttaaagtttttcatgccctttgtcattggctggatcattgccatgattgccaatcccctggtgcgtctattggagcggaggatgaggctggtgcgcaagcacagttccatcgtcatcgtggtggcggccctggcccttgtcatcggccttttatacctgatcatatccagaagctttgcgctgctgtatggattcataaaagatcttccggccctgtacgccgggattgagggggatgtgtccaggagcatggagcagattgaccatgtgttccagttcctgccggacagtatccagcagacctggtcggagattgggaataatctgggaacttatctgggcaaggtggtggagggcattgcgtcccccaccgttgaggcggccggatccgtggccaggagcattcctgccattctggtctatatggtggtcaccatattgtccgcctacttcttcattgttgacagggacaatatcctggcctttgtaaaatcccatacgcctgcctggagccagcggtataccagctacttaaagggggaggtccgcaggcttataggcggatatttcatggcccagtttaagatcatggcagtggtatggctgatcctcacggttggattccttgtgcttggggtgggatacgcccctctttgggcattcctcatcgcgttcctggatttccttcctgtgtttggcacgggtacggccctgattccatggggcttaattaagctgctgggcggcgaatatgcctttgcggccgggcttctgctgatttatgtcctgacccaggtcacgcgccagctggtgcagcctaagctggtgggggacagcatgggacttaacccgctattgaccctgctgcttttatatctgggatttaaggtaaatgggattgcagggatgatcctggcagtgcccatcggcctgttttttgtaagtctgtatgactatggggctttccgcaaaatgacggacagcctgggtatcctgattaaggatatgaataccttccggaagaaggaataagtttgattagcaggagaaggtttaagtgagatgaaagttgaaaataatctggatacggataaagtacgcgggctggtttggaggctggcatttccctccatgctggctcaatttgtgaatgtgctgtacagcatagtggaccggatgtacattggaaatatagaggggatcggggcactggccctggccggggtgggaatctgcggacctgtggtgacacttatatcctcctttgccagctggatcggagtgggcggggcgcccctgatgagcatccgcctgggacagaagaatgagagggccgccactcagatggtggcaaactgttttgcgcttttaacagggatggcggttgtcatcatgaccattaccttcctgttcaggaaaccgctgctggtatttttcggcgccagcccatccatattcccctatgccgacgagtacatgagctggtacctgtccggaaccgtgttcgcgcttctggcagcaggaatgaaccagttcatcatctgtcagggatttgccaaggtggggatgaaatccgtggtattaggggccgtatgcaatattgccctggatcctgtttttatttttgccctcaacatgggggttaagggagcggccattgccacggtgctttcgcagatggcctcctgcatctatgtgctggtattcctgttcgggaaaatgcccctggtgcgcattacctttggcgggtaccggtggaataccatgaagcaggtgctggtggtggggctttcccccttcctcatcattgcgtcggacagcctgcttatcattgtcatgaacatggtaatccgcaagttctccaacccggcagacggggacatgctgcttacctgcaataccattgtacagagcttcatgctcctcatcaccatgccgctgggaggaattaccggtggaacccagactgttttaggttataattatggggcggggaggcctgaccgcatcaggaaggctgagaagcatattgtttccctgggcctggcatttacagccgtcatgtttgtgattgcccagacagcgcccggatatttcgtgcgtatcttcacaagggaagcatcctatgtggggattacggagtgggcaatccgtatgtatacgctggccgtgatcccattggcggtccagtatacggtagtggacggttttactggaatggggattgcgaaggtggctgtcagcctgtccatgttcaggaaattcgtttattttctggggatgctcctcctgcccatgctgttcggggtggagaaggtattctttgcagaacccatatcggatatcattgcatgcgtcatgtcatcctgcaccttcctgctgttaagcggcagggtactgggggataaccggcgcctgtaaataaaatcatacataatcggaaggaagcggaatatgaatatactggtaagcgcctgcctgcttggcgtggaatgcaggtataacggcaagggcgtgctggatccggctgtgaaggcactgatggacagacattgcctcatcccggtgtgtccggaaatcatgggaggtcttgcaaccccgcgcacacccgcggagcgcgcctgcgggcgtgtcattaccagggatggggaagatgtgacccctgcctatgaaaaaggggcggaggaagccttgaagcttgccatgctttacggctgcagggcagccgtccttaaggagaggagcccttcctgtggaaacgggcagatatatgacggaacatttacaggaaaactgacagaaggagaaggggtctgtgcaggacttttgaagtcccatggaattaaggtgtatggggagagccagattgaaagactcctggaggaatcagaaaggtattgatgcatgagcaaagaactggataagaaggaagggacatcagtacaggagaagaaggaaaacggacagcggggaaaaagcaggagccgggctgccttcagggagagaaacggcgggcaggccaaggcccggacggatgaggcgccaggcacgccaaagcacggattggggaaggcggcagcggccctgctggcgctggcagccgcaatctgtgtgggcggctatatctatcacgcagtgggttaccgggatgcgtacctgccgcacacggtcatcaacggcatggatgtgtccggcaggaccgctgcgcaggttaaggaaatgatggcgtcaggggtaaaggattacagtctggtcctgaaactgaggggaggtggacaggaagccatatacggcgcggatatcggcctgcacaccgtgttcgacggaagcctggaggaaatcatccggcagcagaacccttatgcctggccaagatacctgttaaaaggaccgtcctatgatatacagaccatgattacatacgatgagacggccctggagaaaggacttaagtccctggactgcttccaggcagccaatatcgtggtgccctctgatgcatacctgtccgattatgtgggcggggagggatacagcgttgtcccggagacagaaggcaatgaactggatctgcagcttgtcaaggcagctgcaggggaaggcgtgcgcacccttacgccggaactggacctggagtccctgggatgctaccgggagccccgcatccgctccggcaacagctcgctggtggctgccagggatgcaaggaaccggtatgtgaacatgaccgtgacctatacctttggcagtaccagcgaggtcctggatggcagcaccatccaccagtggcttttggctgagggggacagcgtgacccttaacagggatatggcaggggattacgtgaaaaacctggcgtccagatataacaccgcatataagaagcgtccttttaagaccagttacggacagaccgtggaggtaagcggattctacggatggaggattaaccaggcagcggaaacagaggaactggtaaggatattggaggcaggggagagcgttgtcagggaaccggtttactcccagacagctgccagccatgacggggcggattatggcggtacatacgcggaggtgaacctgacggcccagcacctgtttttctataaggatgggcagaagatactggagtcggactttgtgtccgggaatgtgtccaagggacataccacgccgccaggtatatttgctctgacctataagcagagggatgccgtgttaaaaggggaaggctatgcaagcccggtgaagttctggatgccttttaacggcggtatcggtttccatgacgccagctggcgctccagcttcggcggctccatctataaaacaggcggttcccatggatgtgtgaacatgccatatgcggcagcaaaggaactgtttgagaatgtgtacgcaggcatgcccgtgatctgctatgaactgccggggacggagagcagccgttccagcacgtcatccggcaaagccccggccccgacaccggcgccagtcccgacccaggcgccggcgccgacccaggttccggttcccgctccgacccagccagagcccgcaccttcagttggggcagccccggaacagacaccccagccgtccgtgcctgcaccgccccagcctgttccgtcggcgccatcccaggcgtctggcgggacgcagccgcaggtatccatagaccctgtgggccaatccacacccgcatccaccgaaggtgcgcagccctccaatccggcggaggggtatgggcctgcatttcagacaacccatcccagcggtgagggcggccctggcgtgggttaggattggaagaatgtagaaaaaagggacttttttgaggtgcggggccctttttctggtgaatttattgacaaatcagggaaagcattttataatgcccttaatgcatctaggggattacttgtaaagccattattcaaaattagggaggatatggactatggtagaagctaagaaagatgtcaaggcagcagcaaagccagccgaagaaacagttaagccagttgtgaatgaagaggtggcggctgctccggtggaagaagtaaaggcagaggctccggcagcaaaggcggcaaaggcaccggctaagaaggcagcgcctgcagccaagaaggcaccggccaagacagcggcagccaagaaggagacagttaagaaagaagctgtcaagaaagaggctgttaagaaagaaaccgctaagaaggaaactgagaagagggcgccggcaaagaccgcagccgccaaggcggcaccggctaaaaagccagcagctaagaaggcagagcctgcagcagccgtacatttccagtttgacggaaaagacctggttgcaaaggatgtcctggaccaggcagttaaggcatataagagcacacacaagggcgttgagattaagaacattgagctgtatatcgttgccaatgaaggagctgcttattatgtggtgaatggcgaaggaaacgatgatttcaagattatgctgtaatccttggcaatagggattgaaggatgaggtgagctgttgtatcattgggatacggcagctcatttgcattgaatgcaaggtatgcgtgtgaaggataaaggtgtgtatgaagaataaaggatggatatgagatggcggatttaccggttcggtttaaagagcggatgaaggaattgctgggagagggatatgaggcatttgaagccagctatgacagggaacgtgtccagggactgcgcctgaacagccttaagacagcagaaggaatgagggaaggctgggaggaggacggtgtccgcgcgctggctgaacaggtggcggcgcaggcagggctttgtcttgggaagattccgtgggtaaaggaaggattttattatgacgctgctaaaagacccggcaagcatccctatcatgaggctggcctgtattatatccaggagccaagcgccatggcggtaacagagcttctggatcccagaccgggagagcggatcctggatctgtgcgctgccccgggaggcaagtccagccatatcgcgtcacggctgaaagccaggggattccttctgtctaatgaaatccatccggccagggcaaaggtcctgtcccagaacatggagcgcatgggtgtcaggaactgcgtggtaaccaatgaggattcaggaaacctggcgtcccatttcccggaattctttgacaggattgtggtggacgccccctgctccggcgaagggatgttccgcaaggatgaggctgccagggagcagtggagcgaggaacatgtgaggatgtgcgcagggcgccagggacagattcttgacaatgctgcagccatgctccgaccgggcggccgtatggtctattccacctgtacctttgccccggaggaaaatgaaggcgccatcctggcttttctcaagcgccacagtgggttctgcctggaggcagtggatgggtatgaaggattttcaaggggaaatgcaggatgggccgcatatggcggcgctggattggcggatgagcctgcagaggatcggtatcatctggaacggacgttccgtatcatgcctcagaacctggagggagaggggcatttcatagcggtccttaaaaaggaagggccggatgtccatgaagggtatccctgcatgaaaacagcggattatctgaagggcaggaaaaaagaagagcttctgaaagaatacagggaatttttaacagacagcctgacaggacctgaacattaccttatgcgggaagaatatgtattattcggtgaccagctatacctgctgccgccggacatgccggatatgaagggattaaaaatcctgcgcccagggcttcacatgggaaccctgaaaaagaaacggtttgaaccttcccacggactggccctggcccttaaaaaggaagatgtgaagcaatggattgaactgccttccgatggtatggaggtaatccgttacctgaaaggggagacactgtcagcagacgggctcctgtcagaaggaagcggcaagggctggggactggtactgacagacggtttcagccttggctggtgcaagatggcaggagggatggtcaagaaccattatccaaagggattgagatggatgtagtgctactccagaagccgcctcatgtcctcgggaagtccggccgtgaattccatcggctctcctgtcacgggatgggtgaagcttaaacggcaggagtgcaggggctggcggctgatataccggtaatccgggtgatagaggaaatcaccgggcaggggatggccgatggatttcatatggacccgtatctggtgggtccggcctgtttccagccagagactgacacaggatagatcaagatgttcattataagcaatccgtctgtaatgggtacaggcggattctcctttttcaaaatccacctgccgttctatggtggagccttccaccctggcgatgggggcatcgatggttcccatgtcccttgtcctgccgcaaacaatggccctgtactcacgtttaatcctacggtttagcatatcattggaaaggacgcaggcgctgagcatgtgcctggcaaggatgagcaggccggtggtatcccggtccaggcggttgatggcccggtaggtgaagggttcccctttctggctgtaataccaggccacggcattggccagggtattgtcatgatggccctgggacggatggatggggactccggcctccttgttgatgaccagtatgtcctcatcctcatatacgatggagaggggaaggttaaccggtacaatggaccgggatggattgtcttctgtaagaaccacttttaggacctctccgggctgcagcctgtgtatggtataaaccggctgtccctttacggtaaggctgccctccgtattgcgcagatataccaccaggcggtgggaatagccccggcttttcaggaattcttccacggtacagccggtatatggttctgtgattgtgtattcgatgcatttcttaatcatggaatctcctgttatcggtatctatagtcactttccaggtaattacctgtccatgtcctcctggcggttcagatgctttttcttgctggccgcatggtccacaatggagtctttctggaggaagctggcgcgtttgatgctgtcaatgccgtatttgtttcgtattttatccactgttttttcgaattcttttttctttaacagtccggggtcgtcaaaaaggctgatttgggaaaatgaatcatctgcaatcttgcccgccctgacgcccatgagccgaaggggggtcatgtcccagaaatccttaagcagccggcaggaacattcatagagcacggaagtggaatccgttggctctgcaagggtcatctggtgggactggttcttaaactcccagtcccgcagttccacacatacgttgctgcacagaacatggtccgccctcagcctggcccccacggtttcacagagggacagcagcacctggcatgccttgtcatgatcagagatgtccctggacagggtaatactgttgccataggctttattgacagggtcccgttcctcaaccgggtcctcatccacgccattggcgtactggtgtatcaggactgcgtaacttctgcccagatgggctttcagcagttccaggtcgcaggcagccagctgaccgatggtatgaaggccaagggcctccatctttttctgggcagcgctgcccacgaagaaaagctcgcgtatgggcagcggccacattttcccgggaacctcatgggggaacagggtatggcagcggtcaggcttttcaaagtcagatgccatcttggccagcagtttattgctggaaataccgatgttcacggtaaagccaagttcattcttaatccgctcccgtatctggctggcagtggccagcggatccccgaagaggtggatggtttccgtcatgtccaggaatatctcatcaatgctgaatttctcatggtcaggtgtgtattcctccagaagttccatcatgcgcctggaacacttaatatagaagtcaaagcgtgaggggacaacggtcaggttgggacacttgcgcctggcctgggccaggggctccccggtggtgaccccgtacttcctggccaggggggatttggccagtacaatcccgtgcctcatgctggcgtccccgccgacagcagaaggtatggtgcgcagatccagcgcatccggatcatggcttaaccggtagacacactcccagcttaaaaatgcagagttaacgtcaatatgaaagataagccgctccctgtccccatgttccataccttttcctgatcctcttttatcctgggcattccccattgataccaccgtcctttttgtccttccggtccacatgtataaagaaacatgccgtccctgtccccgtctgaaaacctggatcaggaaaacagaacatatattcccttcctacattatagtttaaggttaaccgggcatcttgtcaatccgtttcatggcaggcagatacgccctgattcatcatcatggtttttacagggaacgcgtaaggaaaaacataagaaaaagcagaagataaggcagaagcccgggaaattgtttcccgggcttggcctgcgagggtggagtcctcttgcaccgcaatgacgccgtgttcctatacatccccggcataatagctgatgatgctcatataatccgaaggagccggaatatccagcaccagcttcagataccccttgttgtcagaatgctgcctgcgcaggtcatcctgaataccatactgtctgcctatatcggtcctcctgccatctggatggatcatatagacagcgccctcacaggcatttaccgtacgcaggaattcttccacgttaatgatacccagcttaatcataacagaacctcctttttgccgcctgtcatctttgctaatatcattatagtgcaggattcatgcggtttatatatcatatctgccctgtaatatcatgattctgccatcttttcctatactccatgggagagcacccgaagtactccttgaatacactgccaaagtagctgctgcttccaagtccgcaggcatgactgaccgccgtgactgcgtcctggccctgtgtcaacatgcggcaggcctgctggagcctgtagttcctcagatatcctaagggcgtggtgtgcaggcattcactaaaggtacggtagcattcacgttcactgataaaagcagcagaggcaatatccttgaccgaaaccttatcccagaaatgttcctgtatgtatatgatcatcaatttcagcttgtcatccgtcttatccttatccctgccttcttttaacaggggggaggacagggcgaatatcctggcccatatatcagacagggcagagcgcagctttatctcataggcatattcaccggaggatatctgaaaggatttcctgatatccttaaggatggcatcctgctcctgctggtttggatccaggctgatgatcccaatatgggatgcggtcgtaaggggcaggataaatttcttttcaatccggctcccctgagacccgccgatgagggaaacgtcaaaaagatggttcagctggattgtattggcagccctgtccttggattttgtcatgtggagcacattggaattaaccattcccccggagcctgcgggaaaaatcacctttcctttgggtatataatattcaaccacgccggactcaacataaaatagttccacttccttatgccagtgccagggcacaaaacgtccggctttctggatgtcaaactccatataggaactgatataaggaaaatcaggcatgaagtcaggcagtatttcttctttgcttccttcccggtattcaatacagcagaaatttttcagcacagccagtccctcctattcatgaagctattatatcacaccacagaataaatcacactgcctgtgaatacgataaaataaaggcaaagaggcggcaaatcatgaagcaatggatatttacggctgcgttatcgatatcccttgtctgcgggcatctggaggcggcaggaggggaatatagcatacgaaaggagcaggcagggcaggagcaggcagtgcagacacaggaagtacagggccgggcagtgcagacacaggaagtgcagggccgggcagtgcaggcgcaggaagtgcagagccgggcagtgcaggtacaggaagtgcagagccgggtagtgcaggtacaggaagcgcagggccgggcagtgcaggcacaggaagtgcagggccgggcagtgcaggtacaggaagcgcagaaccgggcagtgcagaaccgggcagtgcagacacaggaagtgcagggccgggcagtgcagacacaggcagtgcaggtacaggaagcgcagagccgggcagtgcaggtacaggcagtacagagccgggcaggccagacacagtcagtgcaggcgcagtcaggccaggcgcaggccagccagacggaaaatgcggatttcctgaaactgtacgcccagtcagctgtcctgatggacgggagcagcggccgcatcctgtatggaaaaggacaggatatcatacgtcccatggccagcaccacaaaaatcatgacctgcatcctggcgctggagcttggtaacctggacgataaggtgacggcttcctcctatgccgcgtcccagcccaaggtccatctgggtgtgcgctccggggaagaatacaggctggaggacctgctgtacgccctgatgctggagtcctataatgacgcggctgtgatgattgctgaaaacatcggggggagcgtggaggactttgccgcccttatgaaccaaaaggcagaggaactgggatgcagggacacctatttcatcacgcccaatggactggacggggtaaagaaggacaaagacggcgtggaacacatccattccaccacagccgccgacctggcggccatcatgcgttactgcgtcatggaatccccaaaaaaggaggagttcctgagtattaccaggacccagaaccacagctttacggacagcagcggcagacgttcctacagctgtttcaaccacaatgcgttcctgaatatgatggagggcgtgctgtcaggcaagacagggtttacgggcggggctggatattcctatgtgggcgccatggaaaatgacggaaggacctatgtcatcgcgctgttaggatgcggctggccgccgcacaagacatataaatgggcggacgccaggaagctgtatacatatgggctggagcatttccggttaaaagacgtgttccgggaggaagtcctgccggatattccggtcacagggggattgtgctgggaagaggagggaacatgccaggaatccacaggcgcaagccttcacctgaaggaggaggagatgcacctgcccctgctgctgggggaggatgaagaggtgcaggtgacaaagaaaatacctgccgtgctccaggcccctgtaagggaaggacagaagattgggaccattgattacagtctgaatggaactgtcatcaggcagtatcctgtctatgctgacagaggggtggataagatgacattttccagggttgtttggcatatactggggattttcatggattttggaaagacttaccacattatttaatcttttcttacgaatctttgtattatgtgaagtttcctgcgtttttgttgacatatgaagccttttgccattataataggattaatgtcataaaatagaaattcatgattttattggttatgaatgaaaatacaggagatatatacataatgaaggcaaagaaattaaaaaggggtctggcccttatgcttggggtgatgatggcagcaaatcttccggcatccgtggccacgccttttacaatgcttaattcctatgcatatacagggtccgccacggtaaaagccacatcactgaatgtccgcagcggcgcaggcaccggatattcctccgtgggaaggctggcagcaggcgctgccattactgttattggggagcagcgggggacggatggcaatacatggtatcagattcaatacacgggaaccaacggggcggtgaacacggggtatgtgtcatccgtttatgtgcggctccctgtttcttacacgacagattctaatttcgaggcatatctgaattcccagggatttccggagagttataagaacgggctcagacagctgcaccagcagtacccgaactgggtgtttaaagccaagaatacgggactggactggaatacggtcattgagaacgagtcggtgctcagccgtaacctggtatcctccggcagcgtttcctcctggaagtcggttgcggacggcgcttataactgggataacagcacatggaccggtctggacggaagcaactgggtggcggcttcaccggacatcatccggtattatatggacccgaggaatttcctggatgagacctatgtgttccagttccttgcgcatgaatataaccaaagcacccagaccagggagggccttaacagtatggtaaacggcaccttcctttccggcagcaccaactccaccgggacagggggaagcgatttctccggcggcccgggaggcacgggcggtcctggttcatccggcggcccgggtagcagttccggttcctcgggcagctcatcaagcggcccgggaagggcaggcacgtatgatgacagccagcatggtccgggagtttctggttccccgaacaccagccagccgtcttcggacaccagccagccgtcttcaggcagcagccagccatcctccggcggaggccaggtcagcctggaagcgcctcacgcatccatcacgccaaaagagcgccggtttgtggcttctaatgtaagcctggtggcgcctggacaggataattcctcttcagcgaatggtccggtggcagtggatggcacgggttcctctggcgatagtccgtcatccggcaacagcccgtcatccggcagcccttccggatccggtccgtcggtgggcacatccccctctggcggtacgccatccggtacatccccgtcaggggcgtcatccggcgaggcatcgccctatattgacattatcatgaatgcggcatcccagtcaggggtcagcccatacgtgctggccgccatgatcttacaggagcagggaaataacggcaccagtccccttatatccggcaattattcaggatatgaaggctactataactttttcaatgtggaagcataccagtctggttccatgtcggccattgagatgggcctgcgctatgcatcccagtccggcacctatggacgtccctggaataccgtggagaaatccatccgcggcggcgcccagaattacggggataattacgtgaaagccggccagaatacattctatcttaagaaatttaacgtacagggaagcaatccctataagcaccagtatatgagcaatatacagggagctgcttcagaggcagccagactggcccaggcatatacgtcggatatgaagaatgtggccctggaattccacatcccggtgttcaacaatatgccggagcaggcatgtgtggcccccaccggggacggaagccccaataacaagctttccgggcttggggtggatggatttggcctgacgccttcctttagcagggatacccatgagtataacctgattgtggattcctccgtgggcagccttatggtcaatgccacggcagctgattcaagcgccagggtaactggggcgggaagcatttccctgcagaatgccagcacggatgtcatcataacggtaactgcacagaacggtaatgtccggacctacaccatccatgtggtgaagcaggacggagggccgacttccggaagcacgggaagcccggtgacaccgggcggtggttcaggttccggcagtccgggaagccccggcggcccaggcagctcaggaggaccgggcggttcaggaggacccggcggttccggtccggccgacagcggcagcactccgggcggaagcaatgtaacgattgtacaggtgcagtcctgataagaaatacatgataatctgaaagtaggaataaatgatgataagacgaatgagacaagggattgcagtcctgattatggcatgcatgattgcagtcatgatgccggcccatatgctgaccgcatttgcagccaatgccaaaataacattttctgacccttccgccaccgtgggaagccaggtcaaggtcaatatgaagataaccagcagcagtaatcttgccaatgcagatgtgatgctggcctatgattcaagcgcgctggaatttgtcagcggtaccaatgcggacggaggcgcgggtgcggtccgcgtccacggcgatgcgggaacgcccggcacggggacgcttgcatttaccttgcagtttaatgccctgaccgccggaaccagtaagattacggtgaccagccaggagatttatgattccagctcccagctggtgacagtggagcatgagggaagttcaacggtaaccgtaggcgctcttcagacagcatccaaggatgccaccttaaagagccttaaggtttcaccgggcgaactgaccccggccttttcaccggatgtggatacctatgcggtgaccgtggggacggatgtggacaaactgattgtctatgcagatactacagacgggaatgcccagaatgtagtggttggcaatgacgggctgcagatgggtgagaaccgtgttacctgtaaggttacggcccaggacggcgagaccacgaaggaatatgtcattgtggtaaccaaggcagagggcggcgccagcgctgcgtccggagatgcttcggcagccgaggtgaagatggagatttccaagcgggtcatcaccatattacagccggatgcatcggttgaggttcccatcggattcaaacctactaccattaacattgacggccacaaggtacagggctgggtatggggtgcttctgagaagcctgaatactgtgttgtttacggtatgaatgaagctggtgagaagaatttctaccgctatgatatgaaggacaacgagcggaccatccagaggtattttgcggatccggctgcaagcgacacggtgagcacggacgtattcaataacctggctgaccagtacgacagcatacgcgatgacttcaacctgtttaagatactgctggcagtcacggttgccattgcacttgtgcttttaatcatcctgcttgtggttgtgatgaataagaagggcagggatggaggaacgggtggtgacggcaccacaggttcaagaggcagcagggccaaagccgccgccaggaaaaaggaccagcttccgtctgaggacagcgaagggtatcaggattatgaagatgacggatacggtgatgcctttgatgaccaggaggatgcagacggttatgaggatgatcctgcttacgatgacagccccgccagcaagtaccagatggattatgaggatgggtacgcggacgaagacggttatgaggacacggatgactacgtggatgaagacggttatgaggatgcggatggacacggggatgcagaccgctatgaggaggcagccaggccgtctggcaggccgtcccagccattaaggccagtggaaccgcctaaagcggtgcagcctccaaaggcagtacagcctcccaaatcagttgctccgccaagatcctcccagccggcccgcccgggccagcagccggtaaggccggcatccggccagccccagccagccccggcagtacagcgccagaccccggcagcccagccggccaggccaggccagacatctgagccggtaaaggcccaggtggatgggaatgatgattttgagatattcgatttatagtaagggaaacatatacagataagggatacagcgttccgtggcaggcggggcgctgtattttttgtggattttagcacctttttggcttaatgataaatttttattatcaaaccattacaatatataattaggcataccattttggatttgttataataataacataggtttaaaaatagattatataataaagatggataaccagtaaaggaggaggcatttcatgggatataaggttggatttaaggatgccgacaggatttttgggcagcttcaggacgagtatgagatctgggcacccaagcggtttgtgggaaaaggaagatattcagacacagacctgattaagtatgcccaggtggcaagtgcagaggagattgagtacaaggagaaatcagactttccggcaaaggaagtcttaagccccataacccagtccctgttttattttaccgaggatgaattcattgagagcaaggccggctcaaagaagctcctgatattcatgcgtccctgtgacatccatgcccagcatcaccaggaaaagatataccttcagaacggtggttttgaggatatgtattataagaggatgaatgaacgggtcaagatcgtcatgatggaatgtcaggaaggctgggacacctgtttctgtgtcagcatgggcaccaacaaggcagaggattattccatggcagtccgtttcggtgaggacggcctttccttccaggtaaaggatgaaagcttcgccccgtattttgaaggcatggaggatgatgatttcacgcccgcctttgtggaggaaaatgaactcaaggtaacggtgccggagattcctgacaaggaaatccttacaaagctgaaagaccatcccatgtggagacagtacgacaaacggtgtatctcatgcggagcctgtaccgttgcatgcagcacctgtacctgctttaccaccaccgacatcatatacaatgagaatgccaacgtaggcgagaggaagaggacatccgcctcctgccaggtaaaggactttaccgatatggcaggcgggatgagcttcaggaaccgggccggggacaggatgcgttacaaggtgctccacaagttccacgactacaaggcgcggtttaaggattaccatatgtgtgttggatgcggccgctgcatcgaccgttgtcctgagtacatatccatcgtggctacggtgaacaagatggcggatgccattgaagaaataaaagcaggggaaaatggacaggagaggggataagccatgaagaatattgtaaagcctgtggcatgtaagatattggaagttaagcgtgaaagccttcacgagtatacatacagggtagagacagatataaagccggaacacggacagttccttcagctttccataccaaagattggggaagctcccatctcagtcagttcctttggggacggatacatggatttcaccatccgctccgtgggcaaggtgacagatgagatttttgaaaaacaggcaggggataccctgttcttacgcggcgcttacggcaagggctggcccgttgaccagtttaaggataagcacatggtggtgattacaggagggaccggactggcgcctgtaaagagcatgctgaacaagttttatgatgagcctgatttcacaaaaagcgtgcatctgatcagcggctttaaaaatgaggagggaatcatcttcaaaggtgatttagagcgctggaaagagcgtttcgacaccatctatgccctggacaaagaccataaggacgggtgggagacaggattcgtgacagaattcgtatcaaggattccctttggtgattttggggacgattatgcggttgtggtggtaggtccgcctccaatgatgaagttcacaggtttcgaggtcctgaagcagggcgtgcctgaggagaagatatggatgtcctttgagcgcaagatgtcctgcgcagtgggcaaatgcggccactgccgtattgatgaggtttacgtctgtctggacggacctgtattcaattatacacaggccaaatatctggttgattaagagaggggtggcaaagaatgaatcatgatatagatatcaaaaaggtaaggattaactgcttcaggcagtccaaggtggctggggagttcatgcttcagatgcgtgtacccggagccatgatagaggcaaagcacctgtccatggtgcaggaaatctgtgagcgtttcggaaacgggaccttccatatgggcaccaggcagaccctggatgtaccgggaatcaagtatgagaatatcgaagaggtaaataaattcatcaagggctacatcaaagaggttgatgtggagatgtgcgacgtggatatggaggtcaatgactacggatacccaaccatcggcgcccgcaatatcatgtcctgtatcggcaatgcccactgtatcaagggcaacatcaatacatacgaactggcaaggaagattgagaaaatcattttcccctcccattaccatatcaaggttgcggtggcaggatgccccaatgactgtgtaaaagccaacttcaacgattttggcatcatgggcatcaacaagcaggattatgatattgaccgctgcatcggctgcggttcctgtgtggaggcctgccaacatcacgccaccggcgtgctgagcctgaacaagaacgggaagattgacaaggatgcctgctgctgcgtgggctgcggcgaatgttccttaatctgtcccaccggcgcatggaccaggggaagcaagaagctttaccgtgtaaccctgggcggccgtaccggcaagcagaacccaagggcaggaaaactgttcttaaactgggtgacagaggacgtggtccttggggtattctccaactggcagaagttctctgcgtgggtccttgattataagccggaatatctccatggcggacacctgattgacagggccgggtacaaggagtttgcaaagcatatctttgaaggcgtggagttcaacccggaggccaaggtggctgacaatattttctgggctgagaatgagcagaggggcaacatgcatgtgatgccgctgtcagagcataaacatgcgggacctcaggagaaataataagtaagacgcgcggatgtgtgcggatgaggcaggaatcaggaagaaaagatatgggagccgggcggttaagcccggctcccgtgttcatgccatgacgtgttgtcaaactgtttattcaccgttcagtttatggtttaacttctcataaacctcatgaatctcatccccctgccgcatcagttcctccacatccggtttctcaatgtcatgtatcagcacgttcctggtccttctgagggcgcctattttgttggacaggtccttgtccaggatgtccatgcgctttaaggtgttgatattgaaggcactgtaggacttgggcgtgttccggccggtggcgcggttgagaaggttctcaagtgggacccactggccgaagaagtagttgacggcctggcgggtctccgggtcggagacatcatcgctgctccttaattcctggtaaacatggtaccgcttctcgttgccggtgatgatctggtcgatgatctgctgggaaatgttcctgcggtctttttcaaatttgacggatttcagtataggctcaatgtcctttaccttgaaaaattttaagcggctgagaagcttgaacagcagttcaatattgcccatacgcagttcaatgtcctcttccttaaaatgattgctcaggtaattgtacaggtaggaggccaggtcgtactggctggtaaatgtggtctccttgttctttatcctctcattgcccgcgctctgcagccgttcaagggcaatctccccggtcagcaccagaccgttaagctcatccaggatggacagctcctcgtccgacagggcgccctggaggggcttgtagatcaggtcgtgctccacctcggaccaggcgtgcatgaggacggaggctacctggatttcaatgcgggcctggacatacttcttctggctgggcgatatattctcttcgctgatatgtaccctgtaatggttggcccaataaccggaaaaacgtttgttgtaagtgggtgtcttggactgttccgggaactgctttttctccatgacagtaaaaaggtcgctgataagggcgtccgccttgtcgcggtcaccagggaaatagagggatacgcggacacctgccaggtcaaacatgtcatcgtatatctcgcgcatgtttttgtagggggtctccctctcggcgttccggtggaaggtcttgtatttcagccttcccgggttcttggccctggaagtgacaatggcacggataccggcagactgcagtgctgtctccagctgtttcgcagccaggcgcccggcattttcataaaatgtgtatttcttcctgtaattttctataaactggtttactaaatccatggtgggcacctccctcttgaaacagtatatcttaaggagcagaagaattcaaatactttccagtattttgaaatggaaatttccggcggggattccattgtccggatgggatgggcgtaaatccgttttcacataagttgaggaaaggaattctcaaacatgtccgagtatggtacaattgttacggagataagaaggatgaaagagagagggaacatgaagctgacagaactcaaatgcactgcctgtaacggcagcctgaaactggatgagaacaatccccatatagctgtctgcgagtattgcaggacacgctatgtgctggaggatgaaggggaagggaacgtacggctggccggtgaaccggcaaagatgaatcataccaccatccggccggagctttctaaaaaagccactgggtgggaagcctacggatggaagcgtgttgcgtccgctctggctgtattgttcctgcttgtggtggtgatatccggcctggccgtaaataaagtccggaatgggaaacatgccccggcttccggcaatccgccgtctgccaccaggtatgcatggaaaggaacaggccgggatcctgaggtgacggcaggagcggacgggaaggaagcgcaaaaggaagagctgacaggcatattcggggatatggcagccactgcttttggtaaggcggcagatctgctcagcgatgaggaactggcccgtttccggtggattgaatataaatattccggcgaccatatcatggtgggatacagctttgatgatcccatggaaaagccggaggcagcccttacatggctggaatttgacagggacagcgcaaaaatcaacagtaaggtcctgtcccggtttaccgggcttaagtccctgagcgcggcaggctatctgtcggcaggggatataatggggctggacctgaaacggctcagctgctacggcaagtccccgggggaggtggctgctttgtttgaggacccgggacagttaaaggagcttcgcatcagcgcaggacttgaaagcctggatgggctgggcgcgctgacgggcgtggagaaactggccctcaaaggctccgacctgacggatatcaagcctctggccgccatgaagggcgtcaagtccctgacccttgaatactgcaatgaattaaaggatttttccgtgctttccgtgatggactggctggaagagctgtccattgaatcagagggggtcagggatgcaggttttgtgaaggatatgccaaagcttacgtcattttcactgtccagggccaagatactggatcttgacagcctgaagggcaatacaggcctgacctccctttccattacaaggtgcagcgaggtaaaggacctgagcgcggtatccggacttaccgggcttgaggaactgtccctggaggtgccttacaactgtgcccagccggacctttccggcctcaccggtctgcgccgccttaaggtgaacggcatggacacggtttcctacctgtcagggatgggagggcttgagaaactggaactggaatgggtggatattgattccacggcgccctttgcagggcttgcaaacctgaaggaattaacctgttcccgcatcccggatgagacaaagtgggattttgtggccaggataccatccctggaagtgctgaacctcaatggaataaggacctataaggatatatcaggcctgttcggcatgcccgccctgcgggaactgtatctgaacggggtggagtgtgaactgtatttttcaaagatatcccccaatgaacacttggaggtccttgagatggacggggtgaagctgtatgagaatgtgaagatcagcggcgggggagggattgtatacgtggattacgataaggtggacctgaatgataatacaggttttttgaccgcgttcccgggaatcagaaggctgagcctggcagataacatgctgacggacataagctttgcagcctcccttcccaatctggagtatcttgacataagtgataattatgtgacggatatcaaaccgttggagggactgggcaggcttgggacccttgactgttccggcaatccggtggggaacgtccgtgttttaagcgatgacgtgacaatactccagtgagtaagtgtacactaaataatacagtgacatttggggtaaaatgtagtatacttctaaacgaaatgaaacattgaccatcatttaacgaaaggatgactgaatatgtactgtgtaaagcgcattaaagacgacctgttctgggttggcgggacagaccgcaggctggcattatttgaaaatgccttccctattccccgcggcatttcctacaatgcctacctgcttgtagatgaaaagaccgtgttatttgataccgtggaccgtgccattaaggaacagttttttgaaaacatagaggctatattaaagggacgcaccctggattacgtggtagtgaaccacatggagccggaccactgcgccaccctgggagagattgtacgcagatatcctgaggtaaaggtggtctgcaaccccaagaccgttccaatcatcaagcagttttataactttgatattgattccagggccatgattgtgaaggagaatgatacattctgcaccggaaggcatacatttaccttcatcatggctcccatggtacactggccggaggtcatggtcacatatgataccacggacaagaccctgttttcagcagatgccttcggcaccttcggcgccatgaacggcaacctgtttgcggatgaggttaattttgagcgtgactggctggatgacgccagaagatattataccaatatcgtgggcaagtacggtccttccgtgcagaccctgcttaagaaggcgtccgcccttgaaatccataccctctgcccgctccacggtcctgtgtggaggaaggacattgactggtatgtggacaagtacctgacctggagcagctatgagccggaagaaaaggcggtcatgattgcatatggttccatctacggcaacacggagaatgcggccaacatactggcagggatgctggctgacaggggcgtgaggaatattgcgatgtacgatgtttcctccacccatccgtccaccatgatatccgaggcattcaggtgcagccacctggtgattgcgtccgttacctataacggagggattttcagcaacatggaacatttcctcatggaccttaaggcacataacctgcagaacaggaccgttgcaatcatggagaacggctcatggggcgtgctgtcaggaaagcagatgagggaaatcatcggctccatgaagaacatgacaatcctggacgagacagtaaccgtaaagtccgcactgaaggaggaccagctggccattctggagggcatggcggacgccattgtcagaaccatgaaccagcagtaggatggtaaggatgtaagaacggtaaggacgcaggaacggtaacgacgcaaaaacggggagaggggacggatcatgatcaggagaaaagatgaagctgaagtaaaagtcatgcatgaagtacagaaggggaacggggatgtggttttccacacattcatgacaaaagacgaggcttacggcgcgggaaggaccttcgcaagggtggagttccttccgggcacatccatcggggtgcatgggcaccacggggaatttgaaggttattatgtgctgaagggacaggcccttgtgactgacaatgggactgaatccatactgaatccgggggattaccacatgtgtaaggacggggacagccatggcattgcatgctatggggaggagcccatggaaatcattgcgctgatcatcaatgtcccggcgcggtcttaggatggccccggactataaaagatgacagatggaaaagaaccggcggcaggccaattgcatccgctggttccttttttggcaccagaatacattacagtacattaaaaatatgaattacaatgaatatctggttgtgtttttttagataacgtagtaaaataattaggaaattacaggaaatcagagggctggccccgcaggagttccgtaatatagcggacagcaggaaggatggccctggcttcgctttcgctgcagttgtgcagctcccagaaaagctgctgcttggcgtcgcctatggcatcggagccaggatagaatatcctgtctgccggaatcctgagcgcggtaatcaaaggatagagaacctcaaatttgggattcccgcggaagttttcaatattaataatggtacggacatcaattcccagtttttcagccagtgacgcctgggacagcccctgttcttcacgggctttgcggatgaccgtacctaatgttttaacgtaatcatgcattgtgattcacctcaatactagtgtacactacagtttacatattatgaattactatgcgatacatatattttatgaatccagatacactgatatacaacatgggaagcagataaaggaaagggggatgcaggttcatggatgggaatgcaggtaatggaaaatccggcgtccgcattgtaatggatgcaaagcgggagaaagaatgcgcgggctccctttccgggatttttgatgaacttatggaattcagcatggaaacagggcggtgcaggggagtcttttatacggaagggggatgccgcctttcggtgaaccaatcccttgaggacttccggacatttgcctgggagaacatccaccctgaggagtgcagggattttcttgggatatttaacagggaacatatgaggaagatcatggaggagggtaaaccgctgcgccatgaattccggtgccgggataccggaaggaattacatatggctcaggatactcctgataccggaatcaggcagaggtgacactgtgctctgctatgtgtcggacctgggggataaggatggggaaaactatctgttaaggcagattgtggaacggtacgtgtataggaactgcgattatctcatatgtctggatgcggataaggattcctataccatgtttaaaaggaatgaaggctctgccctgcttcctcaggaatcctcgggcagttacagccagatggtccagacatgtatcaagggttatgtggtgcctgaggacagggagatggtcgacagggagatggaaatccagcatgtcctttccgtactggacgcggaaggcgagcacatcataacatatggcgtaaaagacccggaaaaaggttatctgcgcaagcggttccaatatgtgtattatgacaggccgggcaggatcgtgttccttatgcgcagcgacatcacggaggaataccaggaacagttgagacaaaaggaacggttaaaggatgcgcttaagaatgccagggtggactcccttaccgggctttacaaccggcaggccatatgcagggaaataagccgtttcctggaatcccccgcctgctcgcgcgcagtcctgctgttcatggatctggatgattttaagaacattaatgataccatgggacacagaagcggggactatgccctgcgctgcgtggctgacctgttccgccataccctgcgcgccacggatatggtcggcagggttggcggggatgagttcgttgcgctccttaccgggatttccgcggaaaagggaggcgtggaatgcgcgaaacggctctgtgaggcggtcagcagcatggaagaccccaacatgggtgggcttaagctttcatgcagcataggcggcgccgtatgtcctaaggacggcaatgattacgacaccctgttcgtaaaggcggatacggctgcttatgaggcaaaacggcagggaaagaaccggtacgtgttttataccccgggtctggagctgaagaacggttactgctccagttcaatgtcataggttttcatccagtagttaatctgcaggatataggccatcatctggggacctgccatcagctgtccataccatggcttgccgtaatcgcccgggtttaacaggaactgttccagtttcttcctgtctaggaactgcatcacaggcgcatggctgtcgcccatcatttcgcggacacgtccggccagaagcttttcataagaagtatcataggttttgggataaggggacttgcgcctgaagagtatatcttcgggcaggagtccttttgctgactggcggagcaggttcttgaccacaccgtccctggtcttcatatcccagggcacgttccagacatactccatgatcttgtggtccgcaaaggggaccctggcttccaggccggagtacatgctggtgcggtccatgcggtttaacagggtctgcatgaaccagcgcaggttcagccaggcgatttcgcggcgccttgcctccaccggcgtatcctcggccagccttggtgtctcggctaccgaacgctcataggtattcctgacatagctgtccatatccaggtattccatgaagctgtcattgagcagcaccttcctggcccccagatccatggtccatggaaatgtatgcgcctcaaagcactcctttttgtggaaccagggatagccgccgaaaatctcatccgcacactcgccggtaagggccaccttgttgtgttcctttaccatggagcagaactggagcatggaggagtcaatatcccccatggccggcatgtcatgggccagcacggaatcatacaggcggtctgcctgggtcaggttgtcacattccagatagtggtggtccgaatccaggaaccgtaccatacggtccacaaaggggcggtcctgggagggctggaaggagttggccttgaagaatctgtcattgtccacaaagtcaaaggaaaatgtggtgagacgtttcccttgtttccttaattctgaggcgcagatggcagacaccaggctggagtccacgcctccggagaggaaggtacagatgggcacatcggagaccatctgcctgcgcacggcgtcctggaccaggaaggatgtcttttcaatggttttttcatagctgtcctcatgtggacggctttccagtttccagtaacttttaagccttaagccctctgccgagcacataaggaaatgtccaggcagcagttcctccatatccttaaacacaccgcagccataggtcctggcaggtccgatggagaaaatctcgttcagcccttttttatccaggaccgggcggaccccgggataggcaaggatccccttgggttcggaggcaaagatgatttcctctcccctgaccatatagaataggggtttgacgcctgccctgtcacggaacaggcacagacggttcctggcagtgtccaggatggcaatggcaaatatgccgttgagccgtttcacgaagtccggcccgtattccatatagccggccagtatgacctcggtgtcgctggaggtctggaatacaaggccgcgtcccagcagctcctggcgcagctccccggtattgtagagttcgccgttgtagacaatggcaaatgtctggccggacccggattttaccatgggctggtggcctccggccaggtcgatgatggacaggcgggcgtgggacagcccgccgtgttcgcttaaaaacaggccggagtcatccggccccctgtgtttctggcactgcgccatggatgtaaggatttccctgcaatgttccttttctttgaggtaatggtcatgggggttataaaaaccggcaattccgcacatagttcgttcctcctgtcatggattgatgcggcgtccctaaatcaggaaacaggccgcgatataggtacagacaaagcccaggcataccggaaccaggttcttcctggccagttccaccgggcttacattacagatggcagccaccgggataagaccccagggcacaatggtccccccgcccacgaagatggcggcaatctggccaagggcagccatcacgggcacggaggcgccggtggcaaagccaaaggtgcgggccagggaaccggtcaggggaaggccggagaaaccggagccgtcaaggccggtcaggctgcccaccaccatctggataaaggccgccatatatttgttcaaaggcgcgttctgggccagccacatggcccagtcattcatgattccatgggaaaagcctgttcccatgatggaggtgatgccttcgccgcccaaaaagaagaaggcgccgatgatgatgaccggggcaaatatcttaatggcaaaaaggaaaccgtccgtcacatagctggtcaccttttcaagggagtccttcccaaagccaaggaaggcgccaaggcacatgaggataagggctgttccggacaccatgctggtggcatccccgccctttaagtcaaataccagcatcagcacaatcacgcccacgaatgccagcggggtgaggatggccatgagaagtgccatgttcccgcccttgggagtatctgcttccccggtctggatggtcaggcgcagtccgcgtccttccatttcatccctgtttaacagatatgcgctgcccaccgtgacaatgcccatgacccagaagacgggccatgcctgatggaggatgccggtggtggtgattccggccgccccggcggaaacagcgggcgcgccctggatgacaaagtcatagcttaaggcgaagccgtggccgaacaggttcatggccatggccgcggccaggggattcaggccggccttgacggcaaaggggagcatgatggccccgaccagcgcaaccgaggggctgggccacaggaaaagggaaaataaaaacatggtaagccccagtatccaccaggtgacggaaggcgtcttcatgatttttgacatggggaccatcatcaggtaatcgctgcccaggtccttgaggcatttggaaagtgcggtcaccattgctatggtggccagtacctccatgaattccttaccagcgtagaggatggcgttaaacacggtcatgatggcgcctgtaaaggattttaagccaatgaggcccaggatgaaaagaaaagcaatgcagacagccggcgtgtcccgtctcatgaccatgacagccaggatgacgatgacgccgatgagataagcatagtgcaggggagtcagcactatggtggattcaatcataacagtcactcctgtatctaagaatataatctatagtatgagaaaatccgtgccccggtgaaataatcctgtttttgggggttgattttatggtcaggggctggtatgcttaataaggattaaaataaatgatgaaaggaagtgaacctaagtggaaggtcgaagtcgtaagatggaagcagacaattatcataagcgtatggtagtgggagctgccggtgtggctgtgttttatcaggcatgccccgggacggctttggttccgctttgctttcactgccgttaaccgtctatatagagatacgtttatgatgatagccatggattacgggaacgcccggtcacggggactttttgtaattatggctattttgtgtgctgctttcatgatagtaccattcatgaaaggaataagatgcaggagaattttgatttaaaacagctgatggagctgctggacacaaggcagctccgcaggctcaaggagattttgacggagatgaatgaggtggatatcgcctccttcatcgaggaactggattcagagcggaccgtggtggtattccgcatgctgtccaaggaggttgcaagcgatgtgttcgccaaccttccggtggaaaagcaggagcatatcattaacagcattacggactacgagctgagcgccattgtcaacgacctgtttgtggatgacgcggtcgacatgctggaggaactgcctgccaatgtggtgaagcgtgtgcttaagaactccacaagcgacacaaggaagctgattaaccagttccttaagtacccggagaacagcgccgggagcatcatgacagccgagtacgtgggactcaagaagaccatgaccgtggagcaggcatttgcctatatccgtaagaacggggtggataaggagaccatatatacctgctatgtgatggatgcaaagcggacattggaaggcgtggtcacggtcaaggacctgctgatgaacccatatgatgaggtcataggcagcatcatggatacccatgtgatcaaggcggtgaccacggatgaccaggaggaggtggcggaaagcttccgcaagtacgaccttttaagcctgcccgtggtggaccatgaggaccgtctggttggaatcgtcacggtggacgacgtggtggatgtcatggaacaggaggccacggaggattttgagaagatggcagccatgcttccaagtgaaaagccatacctgaagacaggggtgttctcacttgcaaagaacaggctggcctggcttttaatcctcatggtcagcagcatgataacaggcagtatcctggctaaatacgaggcggcctttgcagtgattcccctgctggtgacctttatccccatgctgacggatacgggcggcaatgcaggcagccagagcagcaccatgattatccgcggcatggccgtgggtgagatagaggcaggggatatcctccgggtactgtggaaggaactgcgggttggcatcattgtgggaatccttctggggctggtgaattatgtgcagttactcatccgtttcccgggacaggagatgctgtgcctgaccgtggtgctaagtcttctggccacagtggtgattgccaagaccattggctgcacattgcccatcattgcccagatcctccatctggacccggcaatcatggccgcgcccctgattaccaccatcgtggatgcggtgagcctggtggtctatttccagcttgcctgcagcctgctgagtatttagggccctggacccgccccccccggtgccggcagtatggtttccagccggatggagcattagtatagcactgttatttacgcaatgctgtacaagtatgacaggagattggataccatgctgttcaacaagcgattttcattaaaaaccgtatattacagaagctttttccttctgattgtcatccccatcctgctggtgggcgtggtcaccctgggcatcatccggtatatgatggagaaatcagccattgccaacatccagaacgcacaggccagcatagagaccagcctttcagagtctgtccgggacatatcccttcagctgtcccatctggtctttgtgaataacggggaaatcatgggactggtatcgggcatggatacggatgacaaggaacagcgctatgatttcagcagccgtctggatgagatgttccgtgtctccatggtcccttcccaggacacggtgtctgccatgttctacctgaaaagcgggaacacggtatatctgaaagacgaggtaatcctttccagggaggagattggccgggagaactggtaccttcaggccctggaacataaaaatgtggtcagcgtgggcgcttttgacacggccaggcagaccattacatattcgcgtcttaaaaaaggggagtttgtgctggcggcagcccttgctcctgattatcaggcggaccgctccgggaaactggagatggtcagcctgttttccgttacccatgtgggtgaggtcatccgcagatacaacagggatgaacagctgggcaccacctttatcctggacagggaagggaggctcctctttgcaggggacaggagccaggaggcagaacgccttatgaaggggctgccgtccacgcaggcgggcatttacaggaccccggtggatgcccagggcacgggccatgttatgaattatacggcggttgtctcctcagtggaagagaatgggtggaaggtggtgtccatggtcagcacatcccgtctgaccgctgcctataaccgggtcatgggaatctccctcctggtcatcagccttctgctcctgctgttctatcttttttccaggtatttcctgggagaaatcatcacaccccttcactcggtgatggaagggatgaaggagatggaggaggggaacctgaccgtccatgtggagccggcgggccagaacgaaatcaggaccatgatccactcctttaaccggatggtccgggaacttaaggcatccatagaggaaaatgaacgggtgcagcagaagaagcaccgggcggaggtcaatgcgctccagtcccagatcaacccgcattttcttgtgaataccctgaattccatccgtttcatggcccaggtgtccaggttcgagggcatccgcaggatggcggaggctttaatcaagatcctttcctgctccttcaggggcagcatcagtttctatacggtaagggaagaactggatgtgctggacagttacatctatctgatgaaaatccgttattccgacggctttgaggtggagtaccacattgaccagggatgcctggattataagatgcccaggctgatcctccagccgattgtggaaaattccattgtccatggcctggcggaaaaggaggatgacatcggccatctgaaaatcagcctgaaagaggaggtggaatcccttctcttcacggtggaggatgacgggcggggcatgacacaggaggaaatagaggcactccttcatccaaaggagagggaggaggatgacaataccagcatcgggattgagaatgtgctggggcgtctgaagctgaacttcggagaacgtggccaggtctggatggagagccggattggacggtataccaggacattcctgcgtattccaaagctttgagaattgttggacagggggaggaacgggatgaaacgtgtcctgattgtggatgatgaaagtattgtcagggtggcgctgcgttccctggctgattgggagaaatacggatttacggtcgtgagggattgtatgggcggccttcaggccgtggaatacatgaaggaaaacccggtggagctgctgataacggatatgaagatgccgggaatggatgggcttaagcttatcagttatttaaaggacatgggacttctgcccgttacggtggtgctttccggttacaatgaatttgaactggtccgggaggcattccggctgggggtttatgactatatgctgaagggggatttaaaccagcgggtgctggaggaactgctggataaggtgaaccgccagtattttaaaggccaggattcgggatgtccagacatggctttaggggacatggaccccatggatatggggcttgcggcaatcaaccttcccaaggatggcaggtatgggatcatcctttttgaagtggtggacttcaaacgccagtccatgcgctttgccgacaatgtggaggaggagatgtcaagacccatgctggacctggccaggcagattccaaggttggctgcaaagggaggtatcattaaggtatatccgtcccagttcctgatgtattacagggtgacggacccggtccagtatcccaccggtattatttcccttgtgcgccagatacagaaggtatggagggactacatgaacctggaaacccaggcctccatcagtgatatcgtggattacagggacatcggacaggcccttgaccaggatatccggcttcttaagtggagcgccctggcaggggagtacggcatgtgcgctgcctgggactttgagggatatctgtccgtcatggaggaaaaaaagcagggctgccaggcattcatgacagccctgttctccggggacaaggtggtttccgcacaggaaaaagacaggcttttatccacaatcaataccatggacatgcagtcagccacacaggagtgcctccacatcctctgtcagctggcggatcagttccatgtatatgaaaatgaattttcaaccctgcttcctgaacgggtcaattactttgagaagataagccgcctgacccaggtaaaggagctggagttgtggatgaataattatttccgctgggtatcggattatctggagaactgccgtgaggaccggcaggaggatgtgataccaagggcccgccattttattgcggacaactatgccagcccggagatgacacttaaaagcacggccgattatgtggggctgaatgaaaaatacttcagtaccagattcaccaaagagacaggcatgaccttcagcacctacctgaccagcgtgcgcctggaaaaggcaaagcgcctgatggaatccacggaccttaagatgtatgagatcagcgaccgggtgggatatcataatgtggagcattttaaccggatgttcaaaaagacgtatggaatcagcccacgggattataaacggggcaggacctgacgaaacatcaagaaatcaaaccatttttcatggataacagcctcttaaactggtaaaatgtggatagaatcaaaggaaaacaggaaagggaggttttattatgagaaagagattactggcgtttaccatgtgtgcggcactggcagcagggtccctgtacgggtgtgccccggaggatggggcaggtacggcacagacaaccaaggcaggaacacaggcccagccatccgatgggacccaggcagaggcaggcgccacggaggcagccaaggcagaggtgaatgaggaactgagcggcgacctggtttttgctatctgggataataacctgatggattacattgacgccaatgacatggaggccaggttccaggaaagctaccctaatgccagcattgaggtggagaagattaaggatgactctgaatactggaatgccatgaagatgcgcgcaagcgctaaccagctgccggatgtgatgtttaataaggcatttaccctgtcccgctttaaggattacctgacagacctttctgatctggaagcaacgaagaataatgaactggcggcaggatatgccctggatggaaaagtccttggcgtgcccatgacagctggttatgaatatgtatactactggaaggatatgtttgaggaagccggtgtcaaggtgcctactacctgggaacagttaaaggaggtttcaaagacgcttcaggactactacggcaaggacaacccggacttcatggccattgccctgggcgcaaaggaagagtggccggattatccgttcatggaattcatgcctgccctggaaaacggcaatgggcagaactggaatgacatggcggggacagacgcgccatttgcggacggcactgatatttccaaggcataccacaaggtaaatgacctgtttacctccggcgtgttcggaaaagacccgctggggcttggcagcgaccaggccacctccctgtttgcacagaaacaggctgccatcaccgcgttaggagactggggccttcagaatatccagaacggtacggatgattactcacagcttgggaccttctaccttcctgtaagggattcggagagcgaccccttccgggtaatcgtacagggcgattccttcatgggcgttaccacccacagcaagaatcctgaacttgccaaggcgttcgtggaatggttttacagtgacgcatggtatccaggctacataaattatgtgacaagcgcttcatccatgaccaatttccccaaagaaaaagacccgattctggcagaggcggacaatgcgcagccggatatggagctggtcatgtatgatggaggaggagatgatttccaggccatccagaatgagactgcctttgattataagaagctgggggcagagatgtttaccaagggatttgaccttgatgcaaggctggatgaactcaataccaagtgggtggctgcaaggcagaagctgggaatccagtaagggcagggattttcagatatagcttagccgggcaggcaggccctgctacatgacagtaacggatgcagcaaaaggaacaggaaccgaaccctgaatcatttttgctgtatccttttttatggagatccatccactatgtgctcatgacaaggaggaaaatacaatgagttcccttgaaaggaaaaagaggaattttatcatactgtccctaatcatccccaccctgctgctgatctgtttcgtggtgctcccggcctttgatttaatgcggatgagctttaccgactgggacggaatgtcgccttccagtaaattcatctggctggataactatatatccatgttcaggaatgcggacctgtggcagtcccttaaaaacaatgcggtttatttcgtggtccacctgtgcatgattcctgtggagctggcctttgcggtgctgctcacctccaggctcagggccgccaagttttataagaccctggtgttcatgccttatatcatcaacggcgttgcgatttcttacgccttttcctatttcttttcaccggttaacggtgcgtttgatgcgattttaaaagcgctgcacatggggatgctgtcccagaactggctgtccgaccccaaaatcgtaaacttcgtgctggcctttgtgtccctgtggaggttctccggttaccatgtcatcctgttcatggccgcccttcagtccctgccccaggatgtgcaggaggcggcaagggtggacggggccaatgcatggcagatgtttaagttcatccagatcccggccatcatgctgatggttgattttgtactgtttgacaacatcaggggtgcgctccaggtgttcgacatcccgtttgtcatgacctcgggcgggcctggctacgcgtcctccacctttaccctgtataccattgagacggcatttacctacagtaattttggccttgcatcaaccatggcagtggccatcatggtcatgatcgtggtgatttacctgattcagaacaagatcatccatggcattgtattgaaaggagataagtgattatggtaaaacgtacaacaacccagatcctgaagcagcttatctgcctggccatggtggccattgtgctggcacccatcatactggtgttatttgcctcctttaagaccaaggccgacatggtaaggatatccccgctgctcctgccgccaaagagccggttcacactggataatttccagaaggtgctgggcaacaaataccttctggtgggatttaagaacacaggcatcatactggcggttagtattttcttcaatgtgatgttcggcaccatcacggctttcatcattgaacggtttaatttccggtttaagggattcattgtgggactgttctttgtagggatgctgattcccagctttgtcactgagattgcacgttttaaggtcatacaggggctccatctttacaataccttgggcgccccgattgtgatttatgtggcatccgacctgatgcagctgtacatatacaggcagttcatatccaccctgcccgtgtccctggatgaaagcgcactgttggacggctgcgggtactttggcctgtttaccagaatcatattcccgcttctggcgccggccacggccacggtggtaatcatcaaggccattaacatcatcaatgacatgtacatcccatatctgtatatgcctaagaacaagctgcgcaccctgaccaccttcctgatggattatgccaatgcccagagggggtcctggcagcagctggcggccgggatcatcattgtcatgctgccaaccatatgcatatacttatttttccaaagatatatccttgcaggcattgcggccggggcggttaaggagtaaaattgcatgaaagaatggcgcgcagtgcatgtggcagacatttcttaatacatggcggacagggaggaaagggcctatgggtcaggatgggacaagaaagaggatggaagagggaaggctgtattatccgggagatacgcagatcttgaaagagcaggaacagtatatggaactgctctatgattacaatgccaccagaccgggtgagggggaaaagcgcaggatcctcctggagaaaatgctgggttctgtggggcaggactgttacattgaaccgcccctgcactgtaactggggaggaaagcatgtgttcatgggggattttgtctatgcgaattttaacctgaccctggtggatgacgctgaaatccacatcgggccgcactgcatgttcggaccgaatgtgacaattgccacggccggacatcctgtggagccggggcttcgcaggcaggcaatccagtataacattccggtgcgtatcggggagaacgtgtgggtcggggcaggggcagtcatcctgccaggagtgaccattggggacaattcagtcatcggagcgggaagcgttgtaaccagggacatcccagccaatgtggtggctgtggggaacccctgccgggtcctcagggaaatcggggagcgggacaggaagttttattataaagagcgggagattgatatctgattggaaccaggaggatttggaatgaaacataggaaagcagatattggatggctggaggatccccaggtattccaggtgaaccggttggatgcacattcagaccatggattctacgaaacagaggcacaggcggaggctggggaaagcccgctcatccagagcctggacggggaatggggatttgcctggagcaggcggccggatgaccggcccgccggattttttgatgaagggtttgatgacagcggctgggataccatagaggtaccggggcacatggaactgcagggctatgacaggatccactacatcaataccatgtatccatgggaaggccatgtagagatgcgcccgccccatattgactgggaccatgacccggtgggaagctatgtaaaggagtttgacctggaggaggggttaaggggaaagcgtgtgtgcatctccttccagggcgtggaacaggcgttttatgtatggctgaacggacagtttgtgggctatggggaagactcgttcacgccttcggattttgacctgaccccgatgatacgggagacagggaaccgcctctgtgtggaggtgtataagcgcagctcggcggcctggctggaggaccaggatttcttccggttctccggcattttccggagtgtgtacctgtatgcgaaacccatgttccatgtggaggatgtatgggtacgggcaggtcttaaggaggattacaggaccggtacatttgccctgggcatcagggtctcttctgctgaagatggcggagggggacaggaaaccagatggattgacagcctggatggaagcggtgtcacggctgagtggaggctgtgcggacaggacggaactgtggccgtgtcaggcaggactggcggggatgatgcaggtccggacagtatgaaggatggcaggtatctgatgctggcggaggaggaaatccccggcgtccggacatggtcatccaaagacccatatatgtaccagctatatataagccttaagtgggatagtggggaggttatcgaggtggtccctctgaaaaccgggttccgccgttttgaaatcaaggataaaatcatgctcatcaacggtgaacgcatcatgattaatggcgtgaaccgccatgagtggaacccaaaaaggggacgtgccgtcacacaggaggatatgcgccgtgatatcgaaatcctgaagcgcaacaacatcaatgcggttcgcacctgccactaccccaaccaaagcctttggtacagtctctgcgatcaaaacggcatctatgtcatggatgaggcaaacctggaaagccacggttcctggcagaaaatgggaaaaagtgaaccctcctggaatgttccgggcagcctgccggagtgggaggcctgtgtggtggaccgggcagcgtccatgctggagcgggacaagaaccatcccagcatcctgtggtggtcctgcggaaatgaatcctatgcaggaacctgtatcctggccatgagccggtatttccacgaaaaggacccgtccagggcggttcattatgaaggggtgtactggaaccggaagtttaatgaaatcagcgatgtggagagccgtatgtatgcgcctcccaaagaggtacgggcatacctggaggacaatccccagaaaccgtatcttctgtgcgagtacatgcacgacatgggcaattccattggcggcatggagagctatatccggctggcggatgaattccccatgtatcagggcgggttcatctgggattatattgaccaggccatctacaggaaggatgtagatggaacggaagtcctgggatatggcggggactttggggacagacccacggattacgccttcagcggaaacgggattgtttttgcggacagaagggaaaagcctgccatgcaggaggtacgctactggtacagcacaaaagaagagcgggaacggtttgaccgggagggccgggacgcagaggcgggggatggcggaaggccgggtggcagtacagagccaggtgttgaaggaaggccggggagcagtacagaggcaggagttggtggaaggccggaaggcaatatagagccaggtgttgaaggaaggccggtaatagttgcaggggaaggaaccggtgaggtgacgaaaagtagcatagggacagggcataagcgtcttaccgtcattcacggggatgttacactgggagtaaagggtgacgggtttcatgtgattttctcctactcggagcatggcatggtgtcactggtgtatgatggcctggagtgggtttaccgtcctgcaatgcctgccttctggagggcatccacggagaatgacaaggggaatgggtttgctgtcaggagcgctgtctggtgcggcgctgaccagtttatcagatgcacgggatggcatgtccaggaaagccctgaccaggtgcgtattacctatgagtacgctgccagcacggtaccggcggcccaggtgagcgtcagctataccgttgacgctgccgggacaatccgggtgcactgccattatcacgggcaggatggactgccccagctgccgttattcggcctgcgcttttccgtaccctttgtggcggggaatgtacagtggaaagggcgccggggagagacttaccctgacaggaaaaagggcggtgcatgggggatatgggaaagccaggttgaaaaaccggattatctggtgccgcaggaatatggctgccatgtggatacacagtggttgcggcttcaagcgcctgaggacggccttaaacgctgtcttgagatagccatggaagacaagccctttcatttttccgcaatcccctatactcctcatgtactggaaaatgcccttcacagggaagaacttccggtaccgcgcaggaccgtggtatcggtgctgggcgccatgcggggcgtgggagggattgacagctgggggtcggatgtggaggaggaataccacgttccgtcggatgaggatatcgaatttgggtttgtgatacgggggacggtatcagggattgtttaagatttcagtcccatctaagtacgtccctggtaataaagattttatagtatttacggatgcaggcaatcctggtacggatagtactccgcccaggattgcctttttttaaatcatcatgttttttgtagatggacgttgattgagctggccggaatctatctgtgggagaaggtatgccgggaagtgaaggggcatggacaccccggcaaggggtacctctggcattcattagattaaccgtgacatctccaggggagatattattccctgtttcaccatcctgaccattagactatagttaattatgcagctgtctgtaaatcccgtcttcatccatatcaggatgctctttaaccgcattataaatccggctgattacggttaggtcctcttcaaggacttcggctgtttcttccggtgataatccctttttggattttttcatgaccagggaaatcagtttaatcatttccccctttttaagtccgtcttccataagcatctgtccaagtagcgtcatacccatcatctcctttaccttttccaaatctgttttattcaggaacttaattgccaatgcgtaaagcacggcttccatatgccggatatcatctttatccgcatcaacctgtgccatgcgcaggatatccattccccggcagatgcgtccgcatatatccatgttgccggacataagaggcgccaggagcagggggaacaggtcgcttctggtgaggcgtcctccctgttccatcttcatttccaggtcattgaagacacggtctgcatcatcatccttaatccggaccaattctatccggtatacgttaatcccacaatttaagcttgttttaggattcctgacatcggcactgcaaaggacagtggtgatgacctggcggccggatgtcaggcttaagaatgcctcgtattcccggaaacgtcttaaatccttttcagtaatcgggtcgctttcaaattccaaatgccgtaataccccgtcatccattatgaaattaaaatcctcctccatcctgcgtacatccagatggacctgttccgtgggggcgattgcagtcatgcggcccttaaccccaaggtaggggagcagttcctgtccaaagaacatggctgctgttttcaggaccttgtcctcaatctggctgggggcgtttaagacatcccgtggtttgtaagatacgttgctttgttccatacagcctcctttaccggtaggccataggtaagctactcctattataacttcttttgaaatgccggacaatacccttattaactaagagtcgtttttaccgttggtgaattaaaatgaatatgtagattgtgattttctaaactctggaatttataaagtaagataaactgaaacttactatcagaatcataaaagatgaaatgatatgttatttggaatagcttcctgatgtgcctgttcatgtccggctattaaagtataaaccgggtcaggggaaattatcaagatatctgtgagaaaaggaatgctgggaagtgaaaaattcacggaaagcccggcaaaccatactctttggcatcctgtgcattgatataaatattctctggatgggccttatttccccgtcgccaccctgaccgtcagcctatggttaattatacaactgtctgtaaatcccatcctcatccatatccggatattccttaaccgcatgataaatccggctgatgaccatcggttcctcttcaagtatttctgctgtttcttctggggataatccctttttagcttttttcatgacctgggaaatcagcttaatcatttctccctttttgagccctttcttaatcccatcttccataagcatctgtccaagtagtgtcatacccatcatctcctttacctttgccaaatctgttttattcaggaacttaattgccaatgcgtagagcacggcttccatatgccggatatcatctttatccgcatcaacctgtgccaagcgcaggatatccattccccggcagatgcgtccgcatatatccatgttaccggacataagcggcgccagcagcagggggaacaggtcgcttctggtgaggcgtcctccctgccccatcttcatttccaggtcattgaatacacggtctgcatcatcatccttaatccggaccaattctatccggtatacgttaatcccacaatttaagcttgttttaggattcctgacatcggcgctgcaaaggacagtggtgatgacctggcggccggatgtcaggcttaagaatgcctcgtattcccggaaacgtcttaaatccttttcagtaatcgggtcgctttcaaattccagatgccgtaataccccatcctccatgatgaaattaaaatcctcctccatcctgcgcacatccaggtggacctgttccgtgggggcgattgcagtcatgtgacctttgattccgagataagggagcagttcctgcccgaagaacatggctgctgttttcagtactttgtcctcaatctggctgggggcgtctaagacatcccggggtttgtaagatacgttgctttgttccatacagcctcctttaccggtaggccataggtaagctactcctattataacttcttttgaaatgccggacaatacccttattcaataagggcagcttcataccgttgataattaagatggatattgaatgttttgctttttgggaaaatatagttggaaataatttgaaacttactatcagaatgattggatcataatgagatatgtgtaattggaatagcctcctgataagcctgctgatgtccggatgaatagagtatagcgccattaagatgccaaaacaagatacttttgaaatataaattaaaaacctataaattaaaaaccaaaaaaattcctctaaaaaaaattcctttaaatcatttccttccacccaatgaacttttaccttgccgtaggtcatgtttgagaatccatttccaatatccagtcctaatatccagtcctaatatccaatcccagaatccattcccgctatccaatctaaggaatccacccaaggtgccctgttagggcaacgcaggatatacagctgacataaagcaattttcaaacatgccttaaatcttcaaacatgcaaaaaaggatagatacattgtaaaaatgcacaaaatccccctccggttttcgtgaggttttaacgaaatggaatggatgatgaaaataatgatttacaaagtacagtattggtgatacattttaaataacttgtaaaacaagtttacacacatatacaaaaagtattataacaagtataaaaacggaggggaagtaaatgaagaaaacaatgaaaaaattagcagcattcatggcagcagccagtgtggcgggcaccgcaatcatgggatgcggttctgcatccgcaggcagcgcaggacagaaggcaggacagtcaggacaggaatcaggaacagcaggagaggcggcaggggaaacagcagaaggcgcggtccatgtgggaatcattttcacggaagcagggcttggggggaattccttcaacgacctggccctggaaggcgtgaagaaggcggccaaggattttgggattacatatgatgaggtggagccaaagtccgtgtcggatgaggaaatcatccaggacgagatggcatcctccggtgactatgatttaatcatctgtgttggcgcggaacaggtggacgcccttaccaacgtggcagccacttacccggaacagcgttttgcgcttctggacgctgattccgacctgtccaatgtggcgtcctattcctgtaaggagcaggagggcgcgttcctggcaggcgccctggcagccttggccaagcaggaagccattgacagtaagctgggggacggcaggaccatcggtttcatcggcggcgtggacaatccccttatcaaccggtttgcagcaggctatcaggccggagccaggtacatagagccggagatgaatgtgctgattgactatgcaggcggttttaatgatcccaccacggccaagaccattgccaatacctttgtggaaaaaggtgctgatgtgattttccacgccgcaggggcctccggcatgggcatgttccaggcagcagaggaaaagggctttgtggccattggcgtgaacctgaaccagaacagcattgcaccggactatatcatggcaagcatgcttaaaaagctggattcctgcgcataccatgccattgccagtgttgtggagggaacctatacaggggagaaccagatgttaggcttaagtgacggcggagtggacgtgaccgtggaaaacagcaatatcaaggttacggatgatatgctggcacagctggaggaactgaaacagaaagtaattgcaggggagatagagataccatctgaactgaactaggagacaggaggcaggtatggacgcaatcaaaatggttggcattgtaaaatgtttcgggccggtacgcgccaacgacggcattgactttactgttaaacaccaggagatccactgtcttctgggagagaacggaaccggtaaaagcaccctgatgaatatccttttcgggctgtatcatccggacgcaggagagatccatattaatggaaaaaaggcatccattgccaatcccaatgatgcctatggactgggaatcggcatggtgcaccagcatttcatgctggtaaaccagctgacggtcctggagaacattatcctgggcaaggaatccggaggtttcttactggacaggaaagagagccgcagacgggtggaggaactggtggagcggttcggcttccggattgatctggatgagaaagtggtgaatctctccgtgggcatgaagcagagggtggagatactgaaaaccctgtacaggggagcggatatcattatcctggacgaacccaccgccgtgctgacaccccaggaggtagatgaattatttaaaatcctgcgtcagctcaaggagaacggcaagaccatcgtattcatcacccacaagcttaacgagaccatgtccctgtccgaccggataaccgttatccgcaaaggtaaagtggtattctgctgtgacaccgcagacaccaacgagaaggaactggccacacagatggtgggcaggcaggtggaatccgtggtggcgggaagaggaaaggccggccccgtggtcctggaaatcagggatgtccgtcttcatgaacgggccgggaatacagtgagcctgaccgtgcatgcaggggagatacttggcattgcgggcgtggacggcaacggacagcaggaactggaggaaatgatagtgggtaaccgcaaggtgacagagggaagcatccttttgaacgggacccccatccataccatgcctgtaaaggacaggaaggccatgggccttggctatataccgtccgaccgacacaagaatgccatgatttccagcttttccatcactgagaatttccttctgggttaccagaaaaatcctcagtactgcaaaaagggctttattgactatgataagctgaaacaggacgccgggaagcaggtggaggcatttgagataaaaatcgctggtgtggaccaggaaatcggccagctgtcagggggtaaccagcagaaggtaatcctcggcagggaaatcagccatgacccaggtctggtactggtggcccagcccgtgcggggactggacatcggagccattgaaaaggtacataagaccctgcttgagctaaaggaccagggcaaggccatccttctgatatcggcggaactgtcggaaatcatgaacctcagcgaccgcatcgccgtgttttacgaaggggaggccagcgcccagtttaccaatggggaatatacaaaggaagaaatcggcctgttcatggcaggaaagaagcaggaggtaaatgctcatgaagtggatatgtaacaagaagaccgcagagataggcaaatccctggcagccattgggctggcgcttttaatcggagccctgttcatccttctggcaggggagtcacccatcagggcctatgcctccctgatacagggcgcgctgggaacgccccagtccattgccaacacaatcagtaaaagcattcccctggcatttaccggcctggcagtggccatgggctcccggtgcggcatgttaaacataggagcagagggacagcttcacgccggggccatggcaagtgtcataacagccctgacccttaacttccttcctgcccccatactgctggttgtcagcatcctggcaggaatccttgcggggatggcggtgggaagcgtgccaggcattttcaaggccaggttcagtaccaacgaggtaatcgtggccatcatgctcaactatatctgtaccctgttcacatcctacctggtcaatggtccctttaagacagaaggttccacggcccagacagaactgattgcagagggaatctggtttggcaagctgcttccaaggacccagctgacatatgccctgttcctgttaatcttcatcgctgtggccatgtacattttcctgtggaagacatcggtgggataccagctccgcgccgtgggggccaatccatctgctgcagggacagcgggcatccgggtgaacctgttccttatcatgtccatgacactcagcggcggcattgcggccatggccggaattacagaagtatttggaaaatatcacaggttcatagaaggcttctccccctccttcgggttcacgggaatcgcggtggccatacttggcaggaaccaccccgcaggagtgcttctcacggccctgctctttggaatcatggacatgggctccctgcgcatgagcagggaaaccatggtcagcaccaacatggtaattgtcatacagagcctggtaatcctgttagtagcggccccggaactgattaaatggggcagaaagagaggatgacatatggaaatgatcaataattttatcggcctgaccctgcagctgtccgtccccattgtcctgggcgccctctgcggcaccatagcggagcgcgggggaatcatactgctgggtgtggaaggaatcatgctggtaggcgcattcgcaggggtcctgggttcctatgtcaccggctcggccctggcaggcgtggcgctgtccctgatccttgggggcctgattggatggttttacgccctgttctgcctgaaatggaaagcacaccagtccgtggttggcgtgggcatcaacctgtttgccagcggcatcacggcagtgatgttaaaagcggtctggcagacagagggtatgtctgaatccgtggcatccatccccaacctgaccataccgggactgtcccggattcccatcataggcgccctgtttaaggaacagtccccctacctctacgccatgttcctgattgtggcaggggtctgggtggtattctataagacaaaattcggcctcaggtacagggccatgggcgaccagccctatgcggtccagacagccggggtgccggtaaaccgctaccgctacacggccatgatactggccggcagcatcgctggcctggccggttcctatctgtccatatcccagaacaacctgttcgtggtggacatgacggcgggaaggggcttcatgggcctggccgccaatatcttcggcggatggcagccccttggctccatgggcgcgggcatgatatttgccattgcccaggcagccaggttctatctcacggatttatccattccgtcccagttcgtgcagatgctgccctatgcagtgaccctgattgtgctgctgtttgtgggaaaacgggtaaaaggtccggaagcacttggcaaactggtggattagttctatactagtatacaggaagcgcggcattgttgaacaagatatatgctgtgccggacatgtataagaactgacgccaaggcgcacgaaaggagcacgggacctgtgaaggatactgttattaatgaaaagaatgtaaagataccgctgtatgtggctgcatatgagaccatcagccaatggctgaaggatgggaaatacaaagctggggacaagctgccgggagagaacatcctggcggaacagctgcaggtcagcaggggtacgttacgtcaggccatgctgctcctgcaggaagacggtttaatcatcaaccaccagggaaagggcaatatcgtcctttccaaccaggatatgagtaaaagcgggctggagcggattgggaatcccatcgtggatttctgcagtgagccggtggaccgggtggtgaccaccatcggcttccagccagccacacaaaagcaccagcaggtccttaagctgcggccctccagcgtggtggctgtcattgacatcacctactattccggggatacgccggccgggttttccatggtgtatatgccccatgaggtgttggacaacagcaatgtggatctggaggacacggatacggtttaccgttattatacggaactgctggaaacaagcggactgtacagcgatacgaaaatccgcctgggacaggccagggagcgtctggccaacatattacacatccaggaaggggaaccgctgcttttgttagaggaggtgctctacacggaatatgacacgcctgtgctgtcacagaagctgtttttcgggccggaccagcatgaactcagtatccgaaggaagaatgacaggaatataataaagaaatcggagcagtgagatgaagacattccataatgaagcaagaccagggcagataggaagtactgtcctgatgccaggcgaccccctgcgcgcaaaatatattgcagacacatatctctcagatgtggtgtgctataaccgggtaaggggaatgaacggctatacaggttattataaaggaaaacgggtttcggtccagggaagcgggatgggaatcccgtccatgggcatctatgcctatgagctgtaccatgaatatgacgtggataccatcatccgcatcgggacagccggggccgtgcacagggacgtggggataggggagctgatcctggccatgggatgctgtaccaattccaattttgcgggccagtatcatttgccgggaacctttgccccaattgcggactttggcctgttagaggcggcggcggcccaggccagcagcagcagcatacccttccgggtgggcaatgtattcagttcggacgtgttttacgaagaccggaaaggggaaaagggagagtgggagaagatgggcatccttgcccaggaaatggaaaccctgtccctttactgcacagccgcccgcgccggtaagcgggccctggccatgctgaccgtggggagcagcatccaccatgacagggctttgagcaatgaagagcgggaaaagaacctggatgcaatgatccagtgcgcgctggaaattgccgggtgattgccggaatatagataagaaaaagacgtgggcggacccatgcattcattcatgcatttgtccccacgtctttttatttgccggaacatttccccagcctcttttttgtatacttcctggccttgcatttacaatgcccgcacccggcggccagacgggtggccttcttcacttccttaaaggaaccggcgccgtccgcaatcgcttttttgatatctgcctttgtcactttaaaacaagggcatatgtacttatcctttcccattacagcaccagggagggagcggcatagacccttgcggccagttcggaatccagcatataaagccccttggggtcgtggccgaacaggtcatagcgttttaggagctcactggcatttttctcctcctcgccctgttcttttacgaaccagtccaaaaactgcatggtacggaaatccttaacagaataagctgcatcataaatcacatggataagcccggttacatacctttcatgttctaacccggcctccagagggcctctgaaatcctcaaatgatttgtccggcttatcaatggcctccaatgtgacaccggcatcgttgttctgcaggtattggatgaacagcatggcatggtcccgttcttcctgggcctgtacctgataccagttatgaaatccattcagctccgcatccttataataatttgcaaaatccagatacaggtaagcggagtagaattctttgttaatctgtgtgtttaataactcagcaactgttttgtccagcatgtctgtttcctccttaggtttctgtttaaacgataaatctgactgccgtgccgtaagcaattacctctgcggctccctgcatgacagcggaagacgcataacgtatattgacgattgcatcggcgcccagttcctcggcttccatgaccatgcgcttggtagccagggcccgcgcctcattcatcatttcattgtaggccttcagctcgccgcccacaatggtcttgaagctttgggtaatatccttaccgatattcttggactggattgtgcttccctttacaaggcccagcatctccagttcctttcctgtaatataatcagtatttactaagatcatcttcttcaccgctccttatctctaatatcctgcataccaggttgtaaatggaaacgccgatcaatcccatgaagataagacacagtatcagcttaagcagcaggggaatgggcgctatggtccagatacagaggtaaaatgcaaaccacagtaccagcagtaccgttatgacgaccggggcaatgatttttttccaatgcatgggctatgcacctcctttcatctgtaaggcgtccagatacaacggtttcatatccatcatacttggtttaccggactttggcaagaaaaacatggcagtccccaggactttttgatgtaactttttccagattataggaaaatgtatctgatatcacatgatgttggtgatattgtttatattatcataaaaaacagattatttagacaattaaaaacaaataaactaataagaataaaaatatattgaaaaagtattgacaaaacagccctgattgagtatactaaaactaacaaaaggaacgaaataaaaacaaggaggtacagtccaccagaaacagatttatcgttttccatatgatttcatatcatatgtgaaaacagtgaataacaaacctgcctgatgaaatgttaaataggaaaccagatacaatggaagtatttattttcgaaaaccaagtaggttatcaaggaacgtgaacatttgaatgatatgacgagaaagtatcatttaaatgaacttgataatgaaaggtgaagataaaacaacatatgtatatggaacacctggaaaacaaagtaaggagagcagaagaaacaaaaagacaggtatcgaggaagagaaatctgaatcgatacctgttctttgtgcacactctagtactccatccagccatcatgcagggccggcaaaagggccggtgcccatgcttcagccaggcggtccagtgtgaatgcggcgttggccgggctggtggaaggacacctgactgcgtcgcgtccggtctgttcccggcagtatttcatgtacagtccatgggcggtgccgccgttggtgatgatttggcggatgcgggcggctttcagtatcctgtttaagtccatgggaaccacgttgcggatgctctggtcactggaacccttgatatcgcaggactctatcacatcccaaagcgcaatgcccctcaagagcaggatgcccttcctggattcataatcagggggaaagggttcttttagcaggcgctccatcagcttccagaaccggttctggggatggccgtagtagaagtcccgctgcctagacctgacagatgggaagctgccaaggatcagtatccgtgagttcccgtcatagaccggttccagggtgtggaagacccgggtatatccgggaagcagttctgttccagcaggtttttcttcacgtgaaggttggatgttcttttccgtagacatatggtatgctccttttcggtgtttctggtcaggcaggtatctgcatgatagtattgtaccacgattcacggaattagcaacttttggaaacccctattgacaatggggtgtggattttactataatgatagtaagtataaataggtttgtttagtgcgattgttttcgatgtgttaggtctgcgccccgcggccaataagacagtaaagaacccggaacaggacggcgcggtcagcgtctttctgttctgtttttattttccataagaaagagaggtagccatatgaaccaggaccagttgaaacgtatgagtgaaggcaaggggtttattgcagcattggaccagagcggcgggagcacgccgaaggccttgaagaactatggtattaatgaggacaggtacagcacggatgaggagatgttcaacctggttcatgagatgaggaccaggatcattaccagcccttcttttacatcacagcatatcctggcggccatcctgtttgagaataccatggagcgcaggattgacgacaggcttacagccgattacctgtgggaggtaaagggaatcatccctatcctgaaagtggataaggggctggcagaggaggaggacggggtgcgtcccatgaagcccataccgggccttgatgaccttcttgccagggcaaaggaacgccatattttcggtacaaagatgcgttccgtgattaaaaaagccaacccggaaggaattaagaagatcatcggccagcagtttgaaattggccttaagattgcgcaggcgggcctggttcccatcctggagccggagattgatatctacagcccggataaggctgagtgtgagagaaccatgaaagaggagatgaagaaacatctggcggagcttccccaggataccagaatcatgtttaagctgtccattccggataaacatggtttctacagcgatatcatggaagaccctcatgtcatccgggtggtggctttgtccggcggctattcaaggcaggaggccaatgagcggttaagccgcagcccgggcctgatagcaagcttttccagggccttgtccgagggccttaatgtggaccagacagcaggtgagtttgaccgcatgctggcccagtccattaaggaaatctacgaggcttccattacctgatggcaggggatgtaccggataggcagaaccggataaacagaaccagatggacggattcggataggcagaaccggataggcagaaccggataggcagaaccggaaaaatagaaccagacggacagaaccggcggataatctggcggaatcagccggaagcagcatatccggatcatagatgtaaatgagcgtgggccccgctggaaacagcggggcctgtatttggtccggatgtatgttcctgtacctacgaaacccagattacctgttcattggtcagttctgccctgtacccatcatggaagcatacgtcatatgtaaagcaccggccaaaccttggacccatctggtaaatcagatatgcctctgctttgtccagatggaagctgatccaaaatccggcttcaggataatacattccggataccgggcttatccggtgcttcacatcatttccgaccacaacaacaggcaggggaccgctctccttgccggtccgtggggaatcatcaggcagatgatccagtctccaggtgcagcatggactgttctttaggtagcctgcgatttcggtggtctggttttgacaatattggatgatggccgattggggcatttccccgtagtacgaagcgtcctggcccctggcatatcctgcaagttcccggaagatgctgcagcacttatccagcagggcatataacagcccgtcggaccttcccatgttaagcgcatacatgacatcgggcatcagctggtcctcaatacatgacagattctgttccaatatggggaagggaggatatccgtagctggtcaggagattaagggcatcctccttaagggacaggggattattggatatgatcacgtgctccagcagtcctgtgatttctttcccgtatggcagtgtgtttttatagtatggatcaagataataatccaggcataacaggagccgttccttggcatttacgtcatttccttccagtacgtcccctatggcggcaacgccgctttccacaatctttttttcatcatcagaatatgtaatgaatcccatataccctcccctgaacgtgtttacgtattgtttgaagcaaatccttttatattcatatgttaccacaagaacacctgcgtgcaaaggctgtcttgtgccataaaatatttcatgctatactggaacatgaaaaatacaggaagtatcaggataaaatatgaaacaggaatattattaccagcatatggataaggcggagcagtccgtataccgcgccatgctggatggatttgagatgatatcgccggaattcccggtgctgcggctggatggaagggatttgtcggagctgttcttcaggctccgcctggaccatccgtctgtgttctatgtggaggggttccgttaccgctatgcggaacattcggattatgtccagctcataccccagtatatgtttgagaagaaaaagattaaggaaatgaaacaagccctggaggccaggatgaaccgtctgatccagccggcaaggaacctttcactggaagaaaaggaacagtatatccatgatttcatctgcaccaatgtcacgtatgataagctgaagaaacagtattcccatgaaatcattggcccgctccagcagggagtcggggtctgcgaagggattgcaaagacggtgaagatactctgtgaccgtctggggcttgagtgcatcatcgccatcagccaggccaatcctgaaaagggtgtgcgctaccgccatgcctggaacgtggtaaagcttaagaatacatggtaccacctggatgccacctttgacaattcccttggaaggtacggacagaagcggtttgattattataatctggatgacaggatgatgttccgggaccatgagccgctggtttaccagataccacagtgcacggacgggacgcatttttattataaagaaaaccggctgtccctcactaagatggaggacgtggccggacgcatgaaggctgtgctgaggaagaaacagccatatttcgtgtttcactggcggggaggcgcccttaaccgcgctgtcctggagcagattgcagggattgcctctgaggctgcaaaggagaaggggaaatacatccggctgtccgtgaattatcttcaggcagtgatggaaatagcggtactggaacaccagatacaggataatatatgcagggaagaagccaatgaaggcgaactggaccatggagcgttaacgaaaggggagggcagtgatggataaaagctggggaagcgtaatcctgtcaggcggcaagggccgcaggatgggaaatgaggataaaagcgggctgtcatatagaggggagacattcctggaagcaatcagcgggcagcttggcatgctcgggggtacctgttacctttccagggccgcctataaggcaggggaggcccatcatggttttactgtgattgaggacacggtgaaggggaaggatggggaatggatcggtcccatgggaggaatctggtcctgttttgaaaggacaggggaagactgcctgttctttgtgtcctgtgacatgccgatgttccggtccgtgatggcggagcggcttttgggatatatgaagccgggggttgacgtggtcctgtggaggaccaggcaggggcgtatccagcccatgtgcggtctttattccaggtcctgtgtgccggtcctcagacagctcatggaacagcaggactacaggatgatggggttactggaccatctggagtgcgtggtggtggaaacatcaaaggagcatatcccggaccagtggttcatgaatgtgaacacgcctgaaatatatggaaagctcaagcagataacgccgtccgtcctggctgtcagcggaagtaagaatacaggaaagacatggcttctggaacatctggtgtccatgctttcccggtcgggtgtgcgcgtggctgtgattaagcatgacggccatgagtttgaggcagacgtgccgggcacggacagccaccggatgaaaaaagcaggggcctttgggaccgtggtctattccggcagccagtatgccctggtcaagagccaggcgggaatggaggcaggggatttctttggattttttcctgaagcggatctgattttattggaagggcagaagtattcttcctaccccaaaatcgaagtgctgagacaggaaacctcatgcagccccgtgtgccggccccagaccgtgctggcctatgtggcggactgccaggtggaccaggagggtgcccgggaacccaggagggtattcacctttgaccagatggatgaggtggcggaactggtcatagggcatatggacggaagcctgtaaatgaacccggacaggaaactgtatgcatggcttcctgtccggttaaggcggcatcttagttaaggcagttattgatgtagttattaatgcagcattttcttaaaattaacctgctgccggcccccgccatatccgcagcgattatagaactcatgggcctgggtccgtgccgcgcctgaaaccagccggacaccgtgggcacccgactcccttgcccatgtttcgattccttccagcagggcttttccaacgccgcgcttcctatatgaatccgcgaccgcgattcccatgatattttttatcactgccaaggagcagccttaatttatccagtgtcatcacgtagtcatattcatatcccatcccgtcccggttcaattcatggatggaaggagcatcatccatcctggcctctcttatcgtaaaatccatcatcataaagtccttcatcatttccctttccccgattcattgttttgaaatatatgggattatatggaattccgtatcattgtacggttcacgatacgtataatctgagtatagcagataaatccatgccctggcaatacccctccgggggagaggggattttccatcctttttctgcttgacgaaacgcccatcccttgctatattaataataacagcaattgttatattgcttgtagaacaaatataacttttatgtcagcataagacgaaagatggtggatttatggtgttaaagattgatttcaacagtgatgaagcaatctatatacagctgcgcaaccagattatcatggggattgccacggatatgatacgggagggggatacacttccttctgtgcgccagatggctgattatatcggcatcaacatgcatacagttaataaggcctattccgtgctgaagcaggaggggtttgtgaagctggaccgccgtaagggagccgtggtgagtttggatattgataagatccagtccatgggcgaactgcgccggaacctggatgtggtgcttgcctggggtatctgcaagaatgttaccaggaatgaggttcaccaggtggttgatgagatttacgataaatacaccagggggtgtatggatacggaagaagatgaggcagatgaaaattaggacgtttttacgccctgaatgactaatggaggattcgtatgttatgtgaaagatgcaagatccgggaagccaatatcaaatacacagagatcattaatgggattaagacagaacacaacctctgctcccactgtgcaagggagatggattttggtcagtacgccgccattctggacggtgaatttcctctgggtaaactcctgtccggccttctgggactggaggacgatgaggaggagacagatgtgcgcggcaaggtggtgtgccctacctgcggcaccagctttgacgattttgtggagaacagccggttcggctgtcctgactgctatggcgtgtttgacctgttcatcaatgacaagatgaagcagcttcagggaagcgagagccataagggtaagcaccccaagttcaggagcacgtttgaaaaggaacatcctgatgtgtccgcggcaaaagaagaggatggccaggatgcgccggacgcctcggatgccaggccggtggagaatacccgccctgccgccgtgaataagcagatccgggaactggagggcaggttaaaggaagcgattgagcgggaagaatatgaactggctgcacagtgccgggaccagatccgggaactgaagaaggaggcgtgaatccatgagcagatggtatgacagcgtggacaacaaaagttccaacattgtttacagccgcatccgcctggcgcgcaactgggatgagtatacatttccttccaggatgaccagggaacagtgcggggaaatgctggaacgcatgagggatgggcttaaggacataggcagcctggacggaatggaataccgttacggacagctggacgagatgcaggatctggagaagctggcgcttagggagcgcaggatactgaacctgtccgctgtgaataagaaggaaccggccggtctgttcctgtcagaggacgagggcagcagcatcgtgctgggcggagacgaccatatcaggatgcagttcctggcatcgggccttaagctggatgaactgtggcacagggcagatgtgatggatgactatatgaatgagcgcttttcctatgcctttgacgagaagtacggctaccttacttcattcccaaccaatgtgggaaccgggctaagggcatgtgtggtgcttcacctcccgaccctgtcccaggtcaggaagttccagagcatcgtgggcgacatgagccgttttgggactgcaatccgcggactgtatggggagggcggcgataattatggcagcctctatgaaatctccaaccagaggaccctgggacagtcggagcgggagattgtggagctggtgaccaaggcggcggcccagcttaacaaccaggagatgagggtgaggaatgctaccctcaatacccagaggctggagcgggaggacgaggtttataagtcctacggcgtacttaagtatgccaggaaaatatcggaaaaggatgcgcgcatcttcatttcccagctcatggcaggggaggaggacggccttatgaagctggataaaaaatgctccctttacagcctgattatcggaatcaagcctgccaatttaaatctctgggccaaacggcctttggataaggatgagatggatgcggtaagggcagcctatgtgagacagaatttacctgagatagcagataagtaatacttgtaaggaggacacggaatatatgatggaacgatatacaccacaggcccaggaagcgctgggccttgcagtggaagtggcagagggcctgaaccatggatatgtgggaaccgagcatctgctgattggacttctgcaggaaggcaccggcgttgcggcaaaggtactggatgacaacggggtggaggaggaccgggtgacccagctggtaagccagctgattgcgcccaaccccaccatccagaccacggggcagaccacctataccccaagggcgcgccgggtcatagagaacagttacagggaagcagtgcgctttaaggcggcgcagataggaaccgagcacatactgattgccatcctgcgggaaggcgactgtgtggcaagccggctgctgaataccatcggggtcagcatacagaagctgtacatcgacctgctggcagccatgggcgaggatgcgcctgcggtaaaggacgagattggcgccaagggcgcaaggaagggcaatgcaacccctaccctggacagctacagccgcaacctgacccagctggcggcagagggcaggctggatcctgtcatcggccgtgaacaggagattcagagggtcatccagatcctgagccgacgcaccaagaataacccatgccttatcggtgaaccaggggtgggcaaaaccgctgttgtggaaggcctggcccagatgattacggcaggcaatgtgccggataccattgcggacaagagggtcatgacgctggatttatccggcatggtggctggctccaagtacaggggcgagtttgaggagcggataaagaaggtgatttccgaggtcatcgagtcaggggatgtgcttttgttcatcgatgaaatccacaccatcatcggcgcgggcggagcagagggcgccctggatgcctccaatatcctgaagccttccctggccaggggcgagttgcagctgatcggcgccaccaccatcaatgagtaccgcaagtatattgagaaggattccgccctggagcggcgtttccagccggtgacggtggatgagcccacggaagaggaatccgaggcaatccttaagggcctgcgcagccgctatgaagaacaccacaaggtggaaatcacggacgatgccctggcggcggcagtgaaacttagcagccgctatatcaatgacaggttcctgccggataaggccattgacctgattgacgaggcttcatccagggtaaggctgatgaattatacaaaacctgccaagattaaggattatgaggcggagattgacgccctggaggagggcaaggaagaggccatcaagaaagaagcctacgaaaaggcgggggagattaagaaaaagcaggaaaaactcagggaaaagattgcccagaccatggaaaagtggcagaaggaaaaggaaaccaggaaactggttgtaagtgagaacgagattgcggatgtggtatcaggctggaccaagattccggtgaggaagctggcggaggaggagtccgagcgcctgatgaacctggaaggcatcctccacgagcgcgtggtgggccaggaagaagcggtgaccgcgatttccaaggccatccgaagaggacgggtaggacttaaggacccgggccgccccattggctccttcctgttcttaggaccaacgggcgtgggcaagacagagctttcaaaggcattgtccgaggccatgttcggcaccgagaatgcactgatacgtgttgatatgtcggaatatatggagaagcacagcgtgtccaaaatgattggatcaccgccaggatatgtgggctacgacgaaggcggacagctcagcgagaaggtcaggcgcaacccctattcagtgattctttttgatgagatagagaaggcccatccggacgtattcaatatcctgctccaggtgctggacgacggtcatatcacggatgcccagggccgtaagattgactttaagaataccatcatcatcatgacaagcaatgcgggagcggaaaacatcatatcccccaagcgtcttggattcggcatgacaagcgatgccaaggcagattacaatttcatgaaggaccgggtgatggatgaggtgaaacgcctctttaagccggagttcctcaacaggattgatgaaatcatcgtgttccaccagctgaccaaggagcatatccgcggaattgctgacatcatgctgaggaccatcgggaagcgcagcaaggaacagctggggatccagctggctgtaacggatggggcaagggagtacctgattgacaaggggtacgacgacaaatatggggcaaggcccttaagacgtaccatccagaacctggtagaggataagatggcagaggaaatgctggacggcagcatcaaggccggagacacggtgaccgtggatttcgacggtgagaagctgacttttaaagccaggtcaaaagcagctcccagacgtaaggcagcggggagcaaggagacaggcgccaggactgcgggcagtaagaccggcgtcaagaccggcacaaagactggtacaaagggagacaccgggtcaggcgccaagaccggtgccaggccaggtccggccaagtccggttcaggcaaggcctctgcggggaaatcaatttaagaattatttcactggtcatttgggatggattgatgtataatttttatgaggaagttacttaagcacaattagcaggaggataagaagatgccggtcattgaagaattaatctgcacggagcaggatggcaccattagttttggcaattacaagttagggcagaaggcaaagaagtccgattttgaatatcagggagacatgtataaggtcaagacctacaacgagattaccaagctggagcgcaatgacatgtttgtatatgaatctgttccgggaaccgcggcagagcacttcagggttacggatgaaggcgtggaattcactgtggaaggcagcaaggatgcgcagattacggtgcagctggagaacgatacggattacgatatttatgtgaatgactcagcggttggaaacatgatgaccaatatgagcggcaaactcagcgtgagtgttgaactggaggaaggtatttccgttcaggtgaaggctatcaggcgggtgtaagttgggaaagtaagtcaggaatgtaagttaaagggccggaagcaattccggcctttttctgtgaaccggggtgtgtctggaacatgcctccgtgaacatgcggacaggaggaagagatggcaaaagcaaagacaactgcatttttctgtaaggaatgcggttatgaatcatcaaagtggatggggcagtgcccgggctgcagatcctggaataccatggtggaggaaccgctggccccatcttcgggcagttcgggaacaaaaggccggagcagccttataagccagtcaggaagcggtgcaggtcatgtaaagcccgcgctgctgtcggagattaatattgaggaacaggacaggatatccactggttttggggagctggaccgtgtattgggggacgggatcgtatccggttccctggtgctggtgggaggcgaccccggcatcggcaaatccaccctgctgcttcaggtgtgcaggcatctggccggggcaggccggaaggtgctgtacatatcaggcgaggaatccctgaagcagattaagatgagggccaaccggattggcccggtgacaggggagctgcgttttctgtgtgagaccagcttagaccggattgagcatgccattgagacggaaatgcctcagattgccgtcatagactccatccagaccatgtaccgggaagagatatcctctgcaccgggaagcgtaagccaggtaagggagtccaccgccatactgatgcagatagccaaaagccggggcattgccatctttgtggtgggccatgtgacaaaagaaggcgtggttgcaggcccccgggtattggaacacatggtggacacggtactgtactttgaaggggacaggaatgcctcctaccgcatcctgcgcagcgtcaagaaccgctttgggtccaccaatgaaatcggtgtgttcgagatgcaggaggaggggctggcggaggttgaaaacccctcggaatacatgctggacgggcgcccggaggaagcgtcaggcgcagtggtgtcctgctcattggaggggacaaggcccatccttttggaggtccaggccctggttgccgagaccagcttcggcatggcccggcgtacggcagccggaacggactataaccgtgtgaacctgcttatggctgttcttgaaaaacgctgccactatgagatgtcccgcctggatgcttatgtgaacattgcaggcggcatgaagatgaatgaacccgccctggacctggccattgtcatggcccttatctccagctacaaggaccggcccgtggacccgcggatgatcatattcggcgaggtagggctttcaggcgaggtccgggccgtgtcccaggccgaccagcgggtgaatgaagccgccaaactgggctttacctcctgcatgctgccaaaggtctgcatggataagatgaagccggtggaaggcctgaaactcataggggtttccaatgtcagggaggccattaacgttttgtaggaaggaggatgggccatggaggcggaaaacggctgtgcggcatttacaaaggctgtcctggataaaggactgccagatgattcccaggcccaggagtttctttttgccatggttccggagttgaaagccatggttggatttgaacagaataacatccatcacgtgtatgatgtgtggcggcataccatgaaggcgctgtcctctgcaggtgatgatgcaattgtccgcctggctgttttattccatgatatcgggaagccccagtgctatacggaagatgaacgcggtaccggacatttctatggacacggggccgtatccgcgggaatgacaggcaggataatggaccgtctgggctttgatcacgatacaagggaaaaggtggtggagcttgtaaaatatcatgacctggacctgcatgggaagcataaaagcgtgaggacctggctgaaccggctgggaaaagaacagttttaccggcttttagaggtattccggtgtgatgcggcgggacagaatcctgaatatcttgaggcggacaatgcaaggacagaccgggttgaagctgtattagatgaaatacttgcaacggaaaactgtttcaggataaaagatctggcagtcacgggtcatgacctgatccggatgggctgcccacagggaaggcaggtgggggaaatgctgcagcggctatgggaggcagtatcttccggcgccgtatccaatgagccggaattattgctggacatggccagggaatggttgtgtgcatattgcacaaaaacggatggaaaatattgagaaaaaaagccaatagactaaaaaacttttagggtatataattatttttgtattcaatattggtgctattcactatgtatatcctgagaattggctcagagtttctaccaactgccgtaaagagttgactacatggatggggtacgttaggacaatgccctgatgtagttggctctttttttggtgccagaaaacggttggcggaaaggagtggtgacagaaagcctgtaaggtccagctacatgaatcacagccctagaaatctgatgacatcatacagattaaaacaaaacatggaggacatagcattggatcagaaaaaaggattgatagaccgctattttggagtatcccggaatcactcaaccatccggacggaggtactcgcaggaatcaccacattcataaccattgcctacatattaattttaaaccctcaggttttatctgacccgtacatgattatgggcgataccataatggcgggcaaaattgcaaacggcgtatttatcggaacatgtatcggggcatttgtgggaacagccctctgcgcattgtatgccaaggttccctttgcccaggcgccgggcatgggcctgaatgcattttttgcctacacggtggtgctggggatgggctatacatatggccaggccctggtagtcgtgttcatatcaggtattttctttattgtcatcactgccatcggactcagggaggcaatcatccggtccataccggatgcggtgaagacagctatcacgccgggtatcggattgtttatcaccatcataggacttaagaacgcaggcattgtcattgccaatccggccacccttgtcagtcttgtggacttctcacagtggaaggcggacggcgcggacatggccctgatcaacggggcgctggtggcactgttaggccttgtcaccatggggatactgcatgcaaggaaagtaaaaggttccatcctgctgggcatcgtggcagccaccctgattgggattcccctgggcatcacccacatttccaatctggatatgaacattggggtaaaattcagggattttgcggaagtatcctttatgaaaatggactttgcagggttatttgcaggggggaacttcatcgagaccttattcacggtcaccatgctggtaatcagcttctccctggtcaatatgtttgattccatcggcacccttcttggggccgccaaacagtcaggcatgattgacgaaaacggggaagtcatcaacatgaagcaggcgctgatgtcagacgcgatatccacggcagcaggcgcaatggtcggaacctccaccgtcacgaccgtggtggaatccagcgcaggaatcgctgcaggcggaaggaccgggcttacaagccttgtcacggcagtcatgttcctggcagctattatctttgttccggtggtcagcatcatcccggcggcggcaacagccccggccctgatttttgtaggtatcctgatgctgggtaatatcagggacgtggactttggcgacatgagcaatgcgcttccggctttctgtaccatcgtgttcatgccctttacctactccattgcaaacggggttgcattcggcctgatcacatactgcctgatgaagcttaccacaggcaggaagcaggacgtcaaggcgctgaccttgatgatttcggctgtgtttatcgtaagatatgcatttatgacattgggatagattgaccgggatggattgaccaggatgaattgaccgggatagattgaccgggatggattgaccaggatgaattgaccgggatagattgaccgggatggattgaccaggatgaattgaccgggatagattgaccaggatgaattgaccgagatggattgacctagatgaattaaacaggatgaattaaagggtataaatgaatgggatatagtggtggatatccggaatatggatattcatcactatatttttatgcatttctgtgttattatggcatatagaaaattccgtacagatactggaccgtgcgccggattggcagtaacggttttaaatgcagggggagtgcaggatgacatatatatcgactcaggagctgttaaaggcattttatacggttaagaaacgtccggggatgtttctgtatcctttaaccctttcctcccttggaaactacatagatggataccggttgtgctgcaccttaaatgccatacatcaggaagaggatgacttcctggaaaatttccgcatctggctgctggactgttatggcatggagcatacgaaccgtttttcctggtgggggattgtgctggaaaatggatccggtgacgggccggaggcattggatgaattctataggatgctgggaaggtatctggaagaactgcagataacggttcctgatgtataaaagaatgcggaaaaggaaccggatgattggaggcgatgaaattgtctggactgggtaacggtgcttttcttatggtgctgatcctgctgttggcaggaatggccctgttcctgctccatggacagaaagaatccgggaagaggttaaagtcgaggtgtaccgggaagacatccggcacactggaatatgtggaccgcggatgttactttaacggatttaaactatccaaacacgggtgggggaattatatgtacggcccatcttttgtgattaccagtcatgccgtttatacatacagtgtggacggaaccaggtatttaggcattgacgccaggaatccccttacattgtccgggggaaggaaccgtggggaagaggcggaaatttattataacccccatgatgtcacggaattctattgtccaagtgaagacaggaatataatatatgcggatttaatcatggccggttttgcggccgcggttattggaatcatctattattttatgtacgtttggaaatgatgactggaaatcgtatccgggcattatatccgggaatgacgggcagcggattaattaagcagcaggaggtatatagatggaagaacatgggacggtttccgggttataccagaaaaatctggagaagttggaaaaaaacaaaaggtggaggaatgcagcttcaattgtctgcatcctgctgggaagctttatcgtggcagtcaatatgaatacctttgtggaacagggaaaactggtgccgggaggtttctcaggacttgccaagctgatacagagagtgggtctgacttattatgataccaggatttcatttaccctgctcaacgtggtgttcaatgcagtgcctgccgtgttcgcttaccgcctggtaggaaagaagttcaccatcctttcctgcgtcagcctgtttacggtatccatcctggtggatgaactgcctgtcatcccgattacaggggacatcctgctgatttcggttttcggcggaatcatcaatggcctggggatgagccttgtcctgaacagcaatgccagcggcggaggaacggacttcatagccatgtccctttccgctaagtataaggtatccacatttaactacatgcttttgttcagcgctgtcatcatcctgatttcgggcgccatatttggaatggataaagcattgtattccattattttccagttctgcaacacacaggtcatcaatacgttctataagaaatataagaaaaagaccctgatgattgtcacggacaatccggccgctgtctcagcggacctgctggaacttaccaaccacagcagtaccatactgaaaggctttggctcttatacggcccataagaaatatctgatatataccgtgctttcggatggtgatgtgaggaaaatgaaaaaacgtatccgtgagcagtatccggatacgttcgtgaacgtcatcaattccagtgacgtggtggggaatttttatatacagccatttgagtaaaggggctggtaaaataaacatgtccgggcatggaatacatgttgttgcgcaatcagtgtgtatagaatggcattggcgattgtgtaactggtgtgtatgataaagacgtaaggaggtatgatttaatgaagcaacgggatttgatgaataagtttgaagagggccgattttgtctttgagcgtcatggaaacaatcatgatgtatatgtacgtggaactgaaggagaagaggttccaaggcataaagagattaatgggaagttagcaaaagcaatcggagaagatacattaaacggttgcttttattatgcttataattagaaaatgaggttaagtgcattataccggctgtcaatgagtttgacacagtaaggtagatgttattgagagatagatataagcatgacactaaaatgtcataagagaagaagaggaaaaattacaaatctatcaggggaggatatgatatgccgaatgatatccatacaacgtctgcgataaacagggataggttatgatgtaggccatggaatgaaaatctgatggcttttgaattgtaaaaatagtataataagacagagtaaggtaattacataggagggggatttcttatgaagaggttagggttttatgtggtaatgatactgttgactttttctctgcagatgcaggtatttgctgcatatcgctgtaccaagccggaagaccagggcaatgaacgggaaagcggagtatggacccaggacgaaaagggttggagattcacaggcagtgacggtcagacctatgtaaaccattggttgttaaacgatagagggttctggaactattttgatgaaaatggctatgcggttaccggcatgcagacgttggaaggaaaaaggcgttattttacaaacagaggcgatatgcgcaccagttattttgtatatgatggacatctttattgtgcatttaaggatggagagatacgtacgagccgtaatgggggaaataatgtcaagaccagccgtaacggtgtaccctataaatttgatgccgatgggcatgcctataacgaagagggaaaatgggatccggttacggcaaaagaactgggacaatccactcagtcgtcagatggtgtaaaagaagggtgggcgcaggaaggaaaaatctggtgctattactccggagggcagaaacttgttaattcctggcatcaggacagcggtttttggtattattttgatgaaaatggcaatatgcttaaaagctgtgtcagggaaatcaatggggcaaaatataaatttgatgtgacaggagccatgactacgtcaggcagtgcaacagatgaaaacggagtgcgttaccttgtacagaaggatggtacgttaaccccagtggatgtggaggcagagaagaggaaagagcggctggcaaacgatcctggtattaatgagcgccagcagatgcttaatgagaaaaccaatccttataacaataacgacaccgttcagtggtttaatgcaacatacgcgattctgacaaagagcaatacgggaaatattcgtgccgtaggcggtgctaccaaagttgatggctactataatgatgggagcagtacggatcagtggtattctgataagattcgccaggggcaggccgaaagctggggggttacggacaggagttccgcagaccaggtgctggagcggctgattgcgagcggaaacgccaccggttcagcctgggactacagccgcgccatgtccaatctgggattttattatatcgcaggatactataccattgaggaaaccttggataaatcacttgagaccgctaaaatcatacagacaaaattcacctcctgggatgattttgtggaaagttacctggcagggtacgcgtcctggtcaggaaccgatgcttctgagcgcaggagtatctatgaacagttgaagacaagcgctttcaatccgttcagcctggactggaatatgacgctggagaagaactggtagatggttgattgggagaatgggccggttcatggtataatgtttgttgatccgggcagtaccatgcccatacttctttagggaaattggattcgtcttataaaatgattagaagtgtatgttccttcatcaaagttattttcttgtataaaaaggcagataaaatatttttaggtacataatgtaaaattattaaaaggcaggtaaaaccatggaatcaaaagaatttatccgatttctacaagagagatttcaaatagagcgaaagaagtttgataggtcaggtgtctatggctacacgcaacggctcctggcttataattcaaataaaattgagggaagcacccttacagaagaacagacggcttctttgtttgataatggtacactgccaaagtcagatgattattatcgggcaaaagatgtagaggaaatgaacggacatttcctgatgttcaataagatgttggatacgttggatgagccattgacccagaaacttatcaaggcgtttcactatgagctgaagagcggagtattcgaggatcgggctaacggatatgcaataggagattataaacagcgtcctaacatgattggaatgtatcagactgccagaccggatcaggtcgaagcggagatgacgaaactgcttgaatggtatggtagccagaaagtttctataagcgttttagcggagtttcatgcacgatatgaaagcattcacccttttcaggatggaaatggtaggacggggcgtttggtgctgtttagagagtgcttgaggaacggaattgttccggtggtgattgaggacagtaatcggaatgaatatctggaagcattaaaggaatttagggaggataatacactggataagatggtaagattgtttgagaaagagcaggagtttttctaccagaaggcaggatattttatttgactgaggtgtatggaatgaatttgggatatgtattggtttatgttcattgaatgtcagaaaatagagatttaagaggttctaaaatgaagaaagtaacaatccatattctccgcaaataacttatggagaactggcaaatcgagttggatatggtctgacaccaaggaatatagactcgtttttggggaatttgtcaagcatttacaagcataatgatttcccttatgtgtctgcaattgtaatcaataaagatagtggtattccaggtccggggtattttgactatttttatggaattaatcggtgtgaccttgattcacaaataatatgttataagaaggatatagaatcgattttaaaacaagagcgttttatgtaaggaaaaatcactaaggggatatggatatggatggaaatcgcgcgaacttaattgttgtatataaggataaagatgaacttgctttaaatctgttacgcaaattgattgaagggaaagatgatatcgaaggtgagggtatagttgggactgaggatgacagtattgctcttattgcttggaacgaaaagatatggttggataacaaaaaggcaggtaatatatgctctaagattttgtttattggaaatgtaaaaggagtggaaaatttaatacctatcattgatattaaatataataagtatggaattgtatatgggtggtcagggagtcaggcagtgattacagtagattcaaaatcattaaagaagaaggaagagtatgatatattcatcaatgatttaagaaataaaacaaatatatcgattgcagcatctgataaaaaagtcagtaaaaataaaaaaacaatattaaagcttggtggtaccctcaccttgccatttatttggccagttcttgcaggaagacatatcaaaggtgtttttgatgacaaagcattagttcgtaaacagcaatttttattaggaatatcagaattgtatcttaatcatttagatgcttttatgaaaggataagaggtttttctatgtcgtcatcttatgagatgaaagatggatgggactttgtagtaaaatcccaaagttcacattgggcaggccaaatgggattacagtacgtaagcagggtggattcagctatacagcagcttgcccaagatatgaattcgaaaatagggaatttgcaagatgtagctcagttaaaaggatttattgctgagatttggcatgcagatacttttaatatagatgctgcattaaaaggctcctcgaataaagcatttatagaaaacagtaatgctcaagcttcagttgatatttctactaattttgatatggcatacagcctgaaatattatgctacaggtaaagacagtgttatcaatcaatctaaaaatgtaattcaggcatataatgaatacttaaataagtgtaaatcagacaatccattatctttagaagaatacatagaaaagtatgggtattcagcggatatgtctgaacttttgcagtctgtatatcgtggccaggaaaggataataccgagtgatcaattagatgaagccattaaatttctggaacgtcaaatagcaaaggaggcatcaaaggaaggaccaaatcgggcggcagttttagctaattatcaagaaacattaaaaatgttatcagaccgtattagggataacgatggagtgacttccactccgcttacaaaagaagaggctgaagctattgcagctttatgtaaaataggtgaattcaaaccggaggactttggattttccttaaaagatcttattacaacagagtatattttgcaacaggcactaaaagcaggctatacttctgcggtcatatccctagtaatgcaaattggccccgaactgtttaaagcaatagattacctgattaaaaatggggaaataaatacagaagatttaaagaggactggtatgaaatccattactgctagcgcagaaggatttttaagaggagcaatatcagcgtcgattacaatagcatgtcatgcgggaaagttaggagaacagcttataaatatctctccaggggccattggtgcagttacaatgattgttttggatacgatgaaaaacagttgtatggtagcttgtggacgtatgagttcaagggaaatggagttatatctgacaaaagagttgattatatcatcagtctccttggcagggggaactatcggacaaactttgcttgcggaattaccggtgctaggatatatgattggaagctttgttggaagtatagttgcctctgttactattaatgcaagcgaaaagacaatcctatcattttgcgcagatactggattttctttttggggattagtggatcaagattatcagcttccagatgggattagtgaatcacttggtgttgatgtgatgactttaagtgtagtagatataaaacagacagatgttgagcgtatttctatacctacagtcaatatcaaacgtgcaaaatatgatactattaaaatcaaagttttacggagaggcgttgtatctgtaaataaaattggatatattttataaattatagtcccttaataaagtggcgatgataaagtaagcaatatttaatggttctatgataagggcacttttatgcatggttttaagttttacaatttacagataactatcggctgccgtattcaaaaacctaaaaatccaaccattcagccctccccgaaataaacaaaataaaagccagaaaacctttaagataaaggacttctgacctcattcgggttgggctattcgttaaaatagtcagcaggggaagaggggctcgaacccccatctacggttttggagaccgctgctctaccattgaactattcccctttgtcggctgcatttctgaacctcaataaggataccatatgatttgaaaagtgtcaaccactttttttgatttattccgtttctattacaaatccctctattacaagtctctattacaaaaatttccgtttttttacaacttttatagtgccgctattgttttgcttaagattatgctatgatattagaaattgttttgatataatattatgagggcaaaatagatagttccaatcagaatgtaacctgaaccatcattagggggttgatattaatgaaaacaaagatacagacagtgctaggcgatataacaaagatacaggggatggatgccattgtcaatgcggctaattcctccttactcggaggcgggggagtggatggcgccattcaccgggcagcaggcaaggagcttttggcggaatgccggcttcttgggggatgtaagaccgggcaggccaagcttacaaaggggtatggcctgccctgcacctatatcatccatacggttggtccggtatggaatgggggaacgcacaatgaagcagggcttctggcctcctgttatcagaattcacttgatattgcagtaaagaagggtattaaaaagatagcatttccttctatttcaacgggaatttatcattttccggtggagctggccgcagaaagcgccgcggctgcggttaagcagttcctattggagcatgacggggctttggatgagattacatgggtgctatttgacaccaggacgaagctgatatatgattctgtagtcagcagggagtttggcagatgaaactggaacaattaaccgataggattttctattatccccaccagccggagacagaccgccccatgctggcatatattaatggctcccgcataagccttgccatagacgccggcaattcggctgcccatgtggatggattctatggggcgctggaagcagcgggtttgaagctgcctgatatgacggtcattacccactggcattgggaccatacgtttgggatgcatcatatccacggtttatcagccgcccatgtgaaaaccaatgaaatgcttaagcaggagcggataaggctggcggacagcgcttatgcggacgcgcttaaggaagaggacccgtgcctgaaacaggaatatgcggacggcagggagattgtggcaatcccgtcggatatcgcgtttactgataaaatgacacttaaactgggtggcctgacagctgatattttccatgcggtttccccgcattcagaggacacggtgctggtttatgttcctgaagaaaaggtgctgttcctgggggattccacctgcggggatttttacaatgacggctatatggataagggaaggcttaagacattggtacggaccatcgaacgcatggactgcaggtactgcatattaagccatgcagggccactgaccaagaaagaactgctggattatctgggcctggtcatggcaggagatgagggccatggccagcaggagaaaccggatgccaccgaaacactgctatacaaggtagcgtatctggtggaggtagaagacagggaagtttccacgaatcatgataaagaggaattgaggaagatggtctggaaggcgcttccagaccaggatattgccatagatgatgtccataccgcggagtggtattccacccaggagcttttgctggatcccggaaccatgaactgtggacggtgccataaatgtaatgcatggacaacggacagggagaaaccggacccggtcagggaactgaccaacggcgcggtggtggatggtgagctgctttgcgatgactgcctgccaaaggggcatccatgggcattctgacctgatatggaatacgcccaatcaggcagggtttaaggaggatagcggtgattgaactgaaaggcagatacaacgaggcaaaaatcttcacggatgtggtggatgacacatcggttgaacaggtcatgcttttacttgatcaggaatttgcggccggaagcaggatacgtctgatgccggatatccatgcaggggcaggatgcaccattggcaccaccatgacaatcaaggacaaggcagtgcccaacctggtgggggttgacatcggctgcggcatggaagtggtacggctggaggagcggcgtattgaccttcagaagctggaccggtttatctatgacaggatcccgtccggttttaacataaggacacagacacacagatattatgaccggtgcaggctggatgaactggcctgtgcaaaaaacattaacctggaccgtgcaggaaaaagcctggggacactgggaggcgggaatcattttatcgaagctgaccaggatgaggagggacatatctatctggtggtgcattccggaagcaggcacctgggactggaggttgcggggcattatcaggacgagggataccgggccttaaacggcagttcccgggaggaccagcagaagctgatcatggaacttaaggcccagggcagggagaaggaaatccagaaggcattgaaggaattaaagaccggggtacgcacggaggttcccaggcagctggcctatgtggagggacctctgtttgagcagtatatccatgatatgaagctggtgcaggaatttgcggtttataaccggcaggccatgatggatgaactggtcagtgggatggggctgcatgtggtcagtcagtttacgaccatccataattatattgatacggaacacatgatactcaggaaaggcgctgtgtccgcaaggaaaggcgaaaggctgataatccccattaacatgagggatggaagcctgatctgcatcggaaagggcaatgatgactggaatcagtccgctccccatggggcggggaggcttatgagccgtacccaggcaaagaattcattttccgtatctgagtttgaagagcagatgaagggaatctacacgacatcggtcagcatggagacactggatgaatgtcccatggcatacaaaggcatgaaggatattgtggacaatatcggggacacggctgatatagaaaaagtgataaaacctatttataattttaaagcagggacatgaggggagattcatggttaaaccggacgggatacagaggatatccaaaatcgacacatatctgaacgtggctgagacatttgcttacagaagcacctgcatcaaacgcaaatacggtgcagtgattgtcaaggacgatgtggtggtctcaaccggatacaatggttcccccaggggctatgacaattgctgcgacatcggctcctgtccaaggattaagcttggactgcaccagggggagggctatggcatgtgcagggccatccatgcggaacagaacgcactgttaaactgttcaagggagcagaccatgggggcagacctgtatctggcaggcgtaaaccctgccgataacacggtccacagggcaaagccatgtccggtatgcgccaggatgatcatccaggcaggcatacgcaatgtaatcatgcgggtgggggagaaggcggacgaatatgtgtcggtgccttcggaccagcttgtctggcataatgactaagggtatatttggaagaatcattgacgggagagatggaaatgggtaaaagtaaacaggataagttaagcgtattcctgagtctggtactccgccacgacccggatgcggcagggatttccctggacggtcacggatgggcgtatacacaggaactgattgcaggcgtcaatgcctcgggacggaggcttgacatggaaatgctggaggagattgtgcgcacggatgaaaagggacggtacagctttaatgaggataagaccctgattcgcgcaaaccaggggcacagcataccggtggatgtggaactgaagcaggtggttcctccggaaaagctgtatcacgggacggccagccgttttatggacagtatcaagggccagggattaaagcccatgagccgtctgtacgtacatctgtcaaaggattacagcacggcagttaaggtgggaagccgtcacggacagccaatggtgctggaggtggacgccggacggatggcacgggacggcgcggttttttatctgtctgaaaacggtgtatggctgaccgggtatgttaagccggagtatttaagtattgcaaaggaaggttaggaattcatatgtcagagaataagtttgtgattgtggacggctcatcactgctgtccacctgttattatgctgtcctgcccagggaaatcatgtttgccaaaacagatgaggaaaagcagaagcattatgataagatactgcacgcagcggatggcacctataccaatgggatatttggcgtgttaaaggcggtggtgtccctgctcaagaagcagcagccggatcatgtggccttcgtgttcgacaagaccagggacacgttccgcagggaactgtacccggattacaagggaaccaggtcggaaaccccaaaacctctgaagcagcagttcgtgctgctggagcagatcctggaggatgcagggttcagggtgctttacagcagccggtatgaggcggatgattacgcaggcagcctggtgatgaagttccgggaccagattcccatggttgtgatgaccaaggaccatgactatctgcagcttgtagatgatgggcataatgtaagggcctggatggtgcagtccaggcaggagaaggcggacgaactgtatgataaatattacgcgccttatggaatggacaaaaaaagcgtcaaccttccggaaaagacatttgagtttacagcggagcatgtcctggcggaggaaggggtatggccccatcagataacggatttaaagggaatccagggagatacctctgacaatataccgggtgtaaagggcgtggcaagcgctgcccccatccttttgggtgaatatggcaccattgaggaaatctatgccgccatccacgaggctgagaaggataaggcctccttaaaggagctgcaggacttctggaaatttggcctgggaatcagccgttcgccctataaggcccttacaaagacaggggaagaggatgaactttgcggcgaagcagcggcattgctttcaaagcggctggcaaccattaaaacagatatcgtaatcgaggagtccctggatgatttccatgtttccggctatgatgaggataagctgaaggcgtggtgcaggaagctggatataaaggaagaatctgtttttggaaaataacagggaaaataatatagaaagacagaaatagaaaaagaaaactggtggaacagcccggggggctatttcaccagtttattgtattccggatgtttttcaaaccattttacggcataggagcatgtgggcacagccttcttgccctgggactggatctggttcacggcagcttccatcagtttgccggccataccctggcccctgagggattcgtccacaaatgtatggttaatatcaacggtattcccatctaggtccgggaatgtgatttcagcaatggcctggccgctgccgtccagcagggcaatccggtttgggtaatacgtaaaatccattttattcctcctgttttccggcgcatatcacgccgttttggtgtgattatatcatttccagcctatatccgcaaggggattatcctattcctggcagttccagtccggatggccctggcccccggttttccagcccggacaatcccggcccagggttttaccatcccaacagttccggtatgggagtgacgaagttcctggcttccggcagcccgcagtcagccaggaagtcccggacaaattccaggacatgacagtaacacagggacagctggccggcaaaggcctctttatccccgcgaatcaggtaatggtaagcagtcatgcttttccggtccaggggattgtctgcctggattccggcgctgaagaaggaataatagtaaccccaccgcagtgtgcccgtaacctccttcagtatggccctgaacgggtgcaggggaaggcattctatgacataccggatgagaaggtcaagagggattgcatagggggccttaagggcaagcttcagttcctccagccgtccggcatcaatctgttcaaaggccagcagggcagcgggacggattgctatggccatgaactggagtccgcttaagtaggtcagggtatcccttttaaacaccttgtttttcatgcagcgcacggttgcattatcgttgaataaggttacctgtgtgccctttacattgtaagtctggcagaaaccggtcttgttcagcatggcaatggccttgcggaccgttgataccgacacattgtactgctctgccagcgctgcctcgggtggcaggaaatcgccgtccccatagacaccaaggccaatctggtcaataagggaccgcgtgatctgcatataataatggtcgcggcccagctggatatgccatgggaacatgtctgtctgctcctcgtccacattgggatagcgggagcatatatccgccagatacatctcaaccgcctgggtaagtgaagcgtacatcaaacggaactgctggtggattcctgccggacttcctgcgccggcggcatccaggatccacatcgggttcccgtatctgctgcagggagtggaaaagcatacctcctgtccctgctccaggaaaaatggaacccgggcgcacagttccaggttggtaagtacgtccctgaacagcaggttgccggacgcatccagtaaatgatgcagtgaaatggatgctgatttccacctggtccgaaggtccttcctgctgtccttgcgcagctgtgcaaaacacagcctctgtatatcgctgctgcataccgccaatgaaaaggaaaagatggagggaagcagtaactccatggtctggtaaacctggagtatggatgtcctttttttgaggacggactgtatcacatgtatgtcgggggaacactggggcctgcggtatatcacatgggaaggtttcctctcctcagtctggatcagtccttcctccttcagggcacggattacatcttttgcggtccgtatccccacattgtatatttcacaaagcccgtttaaagaggggagcagttcgccgtagcctaagtatccggtcagtatctgctcttttaaattccggtacagatagtcaaataaagttcttttttcttccatccataagtcctccgctgtatctggtggttaaccgcatataagcggtccggtatcatacgacattataacatgttctatggattccgccataaaaatgtccggtactatgtgctattgtacacagattccgccttgattaatcgctggccgtaaactaaaatgaaactatattcgaatgatgtggagattatgcaatcatgcaacataagagacatatcctgccggaggaatcaagacctctcatcaggagggtacaggtgggattactatcagtaatccttatttttgtgtttggggtttccatatggaatgcatcagaactccggatggccatgaaccgcagcacaaggtcatatttaaatgatgtcacgacgaatctgtcaagggatatccaggaagcaatccataataagatgaacagcctgatcatggttgcggattccgtaatgcggatgggtatccctgaaaatgaaacatccatccgggattttttggcccgcaaggcggaaatccttgaattcgaccctcttatcctgttggacaggaaaggggattatgtctgttcagaagaagtgtcccgggatatggatcccgaacgctttttcgggatatccagcgtccgctcctcctttgatggggaggtacgggccggttacatgggaggggagagcattttctactctgttcctgtatacggtatggatgggacggtaagcggggtgctggtaggggtgcgcagcaagaagaacatgcagtccatgatagcgtccaaaagttttaatggacagatgctcagctgcattgttgacagccgcgggcaggtggtaatctcgccatctgaactgaaacctttcctgcgtctggatgatattttcagaagtgataaggagcagaaggtggtgggggacatcaggaaaatgcaggatgatatgagaatggggaaggacggcatcctggagttttccgctgtaacgggagaggagctgttcctgtcctataacagtctggatttaaatgactggttcctgctgaccatcattcccgcaggtattatctcaggagacgcaaaccgttatatcctgcagacattttttatcatcggcatcctgattgtgatattctttctgttcctgaatgccatgtaccgtttttaccattcccacaggatgcagctggaacggctggcttttgtggatccgctgacaggcggcgccaaccaggctgcttttggactcaggtaccgtgaactggccggaagcatgaagccgggcggatataccattacggtcatggatgtgagacattttaaaatgattaatgaacgttttggaatccatgaaggaaaccaggtacttgcatatctttatcatgtgatggagcgtcatatgagggctgaagacggcgaattcgtggcaaggagtgagtcagactgcttcttcctgtgcctgaagggaggcggacatcaggaaatacgggacaggatggatgatatggtccaggatatcaattcgttttgcaatccggatcttcccggatacaccttttcattcaggcagggcgcctgtgtggtggaggaaccgggtctgaagattgccatcctccaggacagggcaaggctggcctcacaaagcaggaatccggatctggagcctggatgtgtgttctatgatgacagtctgaccgtggaactgaaaatggaggaggagttaaacggcctgttccaaggttccattgaaaaccatgatttccaggtatacctccagccaaaggtgggtcttgaaagccgcgcattggaaggcgctgaggccctggtccgctggatacatccaaagaggggggtcatatatccctctgacttcattccgctgtttgaacggaatggtaaaatatgtaaactggacatctacgtgtttacggaggtgtgcaggatcataagccgctgggagaaggaagggaaggaaataatccctgtttccgtcaatctgtccaggcagcattttacggatgaggatttcctggaccggtttgcggatattgccggacaatatcatattccggcaggtatgattgagtttgaactgacagagtccattttctttgacagtcatcagatccaacgggtcagggatgccatacaaaggatgcatgagctgggctttgcctgttccctggatgattttggttccggtttttcatccctgggccttttaaaggaatttgacgtggattccattaaaatggaccgttcctttttcctcaacatgtcagggccaaaggcaagggaggtgattgcctgcctggtggatctggcaaagcgtctgaaggtaaagaccgtggcggaaggcatagaggattgggacaccgtggagtatcttaagtccatcggatgcaacatggtgcagggttatgttttctcaaaaccccttccagccgatgcatttgaaaggctgcatatttcctggacaggcagcatagaatgtaatatcaacccttgaaaggagacaatacatatgaccatccacccaccctgccggagcctgatgaaattcggcgtattccagaatctgattgaagcttattaccggttcatgatcaggaggccatgctttgtcatgtggcagaatgggagatggacccttgtgaccttggactgttaaaggcttgacttatgcaaaaatatgttctagtataaaaactgtcaatataagcagcggcctaagggattaatatgaatgaccggaccgcggcaaggacgggagagatacggaatgaataagaaagaagccaatgaaataaaaaagctgtttacaccggcaaactgcgccatcacacgcatctgcggctgttatgtggatgcggagaagaacaagaagacggaacttaaggaggcgttcctatcgcttccggaggaagaggcgtttaagtattttactattttcaggaacgcgctttcaggaaccgttgggaagaacctgattaatatggaattccccttacatacagaggcggagggcggcacccaccacttcctcatgaagctgagggacagccagttaaaggatgatgccatccttgaggaattctatgataaagtcattgccaattatgactatggtgagaattattatatcatcctcatacactgtgcctatgacattccggccaaggccacggacgggactgagatgtttgacgcctcggaatatgtgtacgagttcatccagtgtaccatctgtccggtgaagcttgccaaagcaggcctgagctataacccgctgaccaattccattgagaaccgcagccgggactggctggtggaagcgcctgaacagggcttcctgttccctgcgtttaatgacaggaacacggaccttcacagccttctgtattatgcaaagaatccggaacagatgccggaaaccctgattgatgaactgctaggctgcgtcatccccatgtcggccaagagccagaaggagacgttccaggcccttgtggaagaaaccctgggggaaaactgtgatttcgagacagtgaagaacatccatgagaacctggccgaactggtagaggagaccaaggatgagccggttcccctgaccctggacaagtatcaggtgaaaaagcttttggagacaaacggcgcggcccctgaaaagctggaggaatttgaacagcgctatgcggaggtggaggacgggccgggaaccagttttgtggcggccaatgtgatcaacaccaggagctttgaaatcaagacaccggatgtcagcatcaaggtggccccggacaagacccatcttgtggaaaaccgtatgattgagggcaggccgtgtattgtcataaccatcagcgagcatgtggaaatcaacgggatttccgttcggccggtggcggcccagggacaggatgaggagtcatgatgatttcaggatgttcataagtaaaaatacccattaaaaacagccggcctgggaatcctggattcccggaccggctgtttccggattcgcccttgggcgaatttgaaaattactttccgtcagatgcgctctgaattgtcacgcatgaacttgtactcggcaaccgagcggtcaaaggtctggatatggtagtagagccagtcccttaccttttcctggaccgcgtttacgaaggcatcggaagggccttcctcctccaccagcatgtcatgaagctcctgcacggttttccgcagctcctcatgcttctgcttatgttcctttatgccgggatagctgatggattcctgcagtccttcttcctcgttaaaatgaaattctgtataatctgccaggtaattcaacatcctggccgcaccgctttgattggagcgctcctcacagcttttcagcagatcgttaatcttatcaatcagctccttatgctgggaatcaattaaagtgttgcctgtaaccaggtcatctgtaaattctgcatacatggtctgatacctcctgaatatttgatatttataatttatcacaattaattgtaaattgctatgacttttgcaacaaatataaccacttttgagaaaaggcagatatcgattccctaaaaatatcttcgaaaaagcgaatacactgtaaatagggggtaatatatgggtaagaagttgtctggacaaaaaagtcaatagttgatataatgaccatgtgcatcaggtaatctaaagataatgggaggaaaaaactagagatgagtcgtacaattagtgcaggttatgtatatcgtcaatattctactgaaggtgtgtatctggcagactataaaagctccagggaagcccatgaggccacaggggtatccattggctccatagccagggcggctcatggtgagcgcaggagcgggggcggatttgtgtggaggaaggttctggcagaatcccccaaggaaaacattgagatagacctgaccagcaaaatagggaatcatgataaacgtccgctgctgcagaagaccctggacggcgaggtagttggacagttcctctcaattgcccatgccagccgtgcacttaaaatcagccggaggagcctgtcctgcgccctgagcggcgcccagaagacagccggaggatttgtgtgggaagaacagccggtccagccggaagggccggaggaaacagctggtgagcagcaggaatcagcacaggatgagtaaggcctggaattgtatattacatataagggatatgcatccattataatatagaaggaacaggtatgaccgaacagccgccccaagggcggctgtaatttttttgtatggaaaccatacagacaaaagagaaaaaacgcagaaacctgattgaatttgcgagatttctgtggatatttgcgagaatttatagtacaatagatgagagaatactgacctggatattgccggaggaggaacaggaaatgaaacgtgaagatatggtatggagtgacaggaagaggaactggctgggacttccctggacatttacagtgtatggcctgacagaggaccggcttttcattaagacagggatactgaatatccatgaagacgaggtgcgcttatacaggatactggatctgtccctgcgtaagaccttctggcagaggattgtgggactgggaaccatccatgtggacagcagtgacaagaccatgaaggcatttgacatacataatatacgtgactgtgagaatgtaaaggagcagctttcacagctggtggagcaggagagggataacaagcgcgtatcctcaagggagttcataggcggctatgaggacggggacgatggatttgatgagccggatggccattattaataaaagacactactaagaaaggggattttgtatgggtaaaaaacgcaatataattgttggacagtcagggggacctacatcagttattaactccagtctggcaggtgtgtataagacggcgaaggagaggggattttacaaggtgtacggcatgctccacggcattgaagggctgttggatgaaatgtatgtggatttatccacccagatccattcggatatggatattgagcttttaaagaggacgccctccgcattcttgggctcctgccgctataagctgccggacatccatgagaacccggatatctatgagaagctgttcgcaatcctggataagctggagattgaggtgttcatctatatcggaggcaatgactccatggataccatcaagaagctgtcggactatgccattgtcaagggacacagccagaagttcctgggcgtgcctaagaccattgacaacgatttggcgctgaccgaccacacccctggttttggaagcgcagccaagtacatagccacctccaccaaggaggtgatccgggatgccatggggctttcctataggcgcaagaccatcacgatcatagagtgtatgggaaggaatgccggctggctcaccggggcaacggcccttgcaaagacagaggactgctgcggtcccgacctgatttacctgccggaaatcatatttgatattgataagttccttaaaaagtgcaaggaccttattgttaagaaaccatccagcgtcattgcggtatccgagggaatcagggtcccggacggacggtatgtatgccagctgtcagggggaagcgattatgtggatgcattcgggcataaacagctggccggcaccgctgattacctggccgggttcctggccgctgagctgggctgcaagaccaggtccgtggagctttcaacccttcagcgaagcgcttcccatgtggcttcccgggtggatatcaacgaagcattcatggtgggcggcgcggctgttaaggcggcggatgaaggcgacacaggtaagatggtggtcattgaccgggtatccgatgacccttatatgagcgcggcaggcatctatgatgtccataagattgccaacaatgaaaaggtagtcccaaggaactgggtaaacaaggatggcagctatgtgacgcaggaatttgtcaattatgtggagccgctgatacagggggattaccagccgttcatggtaaacggactgccccagcacctggttttgaagcggtaacatgcctgtgaaggcagaattttctatgaaaagcttaaatttgcccggatgaaatccctgcagggcagataagaatcaggggcggtttccagattactggggaccgccccttaaaatattataattcaataaaggaaaaaccggaaaaatcaatcaacatgcacaataaaaaacggccccctggcagggatggggggaggaacggaatttgacaattgaatataatagtgatatatatatgtcaacctttccatttgtcatttatggacacaccggctttccatgtgaaaggccgggcgtccccaaaaaggagttttgatcatgaaagaaaagaaaatcatattaccaacaatagctgaagcaaggaagtttgtagaggaagctaccaggtgtgactttgatattgatgtattttataatagggtaaccattgatgccaagtccatcctgggagtactgagcctggatctgaccagggtgcttacggtccagttcaacggaaccgatgaagtctttgaggagtatctggataccctttcaccggaatcagcaatcacagctgcataaagaaggacctgccggctaaatcaggaggactgcgaacgtctgtttgcaatcctcctgtttttatgatatgatatcgtaagattatatgatggggctggcatttttggccagcagcagggaggtagcgggatttggacgggcagacacaggcacagccgccaattaagatatcggtacgtaatctggtggaattcgtgatgcgaagtggtgatttggacaaccgcaggaccgccggggcaaagaaggaggccatgcaggctggcagcaggctgcaccggaagatacagaaacggatgggaagcagttaccgcccggaagtggttttaaagcacagggtacgggaggatatgtttgaaatcctggtggagggaagggctgacgggatcatcacggagccggccggtgttgtgattgatgaaatcaaatgcatctacatggatgtgggacggctggaggagccggacccggtgcatctggcccaggccctgtgctatggatatttttacagctgtgataacggacttgacaccattgggatccagattacctattgcaatatagagacagaggaaatcaggcgctttaaggaggagaggggctttgacgacctgtccgtctggtttgaaggtctgatacatgaatatgtgaagtgggccaggtacattcaccatcacggcatgcggcgccaggaatgcttaaaggagcttccgtttccctatccctacagggatgggcagaaggaactggcagtggacgtataccggtccattgcaaggaagcgcaacctcttcatacaggcgcccaccggtgtgggcaagacactttccaccatctatcccagcctgaaggccatgggggagggccatggggagaagctgttctacctgacggccaagaccattaccagaagcgtggcagaggatgcattttccatcctcaggaaggaaagcgggctgtactttaacacagtgaccatcactgccaaggaaaagctgtgcatcatggagaagccggactgcaatccacaggcctgcataagggcaaaggggcattatgatagggtcaatgatgcggtctatgagattatcggggatgtggatgggattacaagggagaaggtcctggaatatgccaagcggtatcagatatgcccctttgagttctgcctggatatcagcaactgggtggatgggattatatgtgattacaattatgtgtttgatcccaatgtaaggctgaagcggtattttgaccagggggagccgggacaggggtacctgttcctggtggacgaggcccataacctggtccccagggccagggagatgtacagcgccagcctgataaaagaagacgtgctcatggtcaggcggatcctcaagtcccagacaggcgcgggaaaggtgctgacacagcttgacaggtgcaaccagaagttcctggacatcaagcgggcctatggttcggatagcggggagggggtcatccaccgccaggtccttggaagcgattatgagctgctgccggatgtgaacctgctggcccttcagctcatgaccatgttcggcgaactggaaagcttcatgaatgagaatgtggagttcggggacagggacctggtgctggatttttactttgcggtccgggatttcctgtatgtctatgacaggctggacgataactacaggatttatgccaggcttctgccggacggacacttcatggtcaggcttctttgcatgaatccggctgtcaacctgaaggaatgcctggaccgggggaacagcaccctgttcttttccgccaccctgctgccaatccagtattacaaggaactgctcagcggcagccaggaggaatatgcggtctatgcgaagtcaccgttccctgaggaaaaccgcctggtgctggctgccagcgatgtgagcagccgctacagccgcagaagcgcctatgaatatgagaagattgcagattatatatgcaggatcgtggaggggaaaagggggaattacatggtgttctgcccgtcctaccagtatctttacgccattgaggggattcttgccagaaggcaggaggagggcggcctggcctttacgtggctggcccagaagaaccgcatgactgaggaggaaagggaggaattcctgagaagctttgacggggagcgggaacagtccatggcggccctgtgtgtgatggggggaatcttttccgaagggattgacctgaaggaggaccgcctgattggcgctgtgataatcgggaccggcctgccccaggtgaatacggagcaggaaatcctcaaggattattttgatgaacacggaggctgtgggtttgattatgcctaccagtatccgggaatgaacaaggtgatgcaggcagccggccgggtcatacggaccatccatgacaagggcgtgattgcccttttggacgaccggttcctgcgtccggaatgtgtggccctgttcccaagggaatgggggtcctacacagtggtcaaccggtataatgtgggacaggcagtggaagggttctggaaccgtttctgaccatgtgcccataaagggccatatgctgtttacaggatatccatgaactgtctggctgcctgggacacaggcaggctttcgttgtaggcaaccatcatctgccgggagggaagctgttcctttaaatccaggatgaacaggttcctgtcctttgcagggatgcagaagtccgggacaaatgcaatccccagcccgatgcgggccaggtcgatgagaaggtcgttactggaaagctcaatctcaggaaccaggtcaagctggcttttctggaatatctgatgcaggaactcactggtggtgctcttgcggtccagcatcatgatggggtagtccagaagctcttccagacccagcttccttccttccaaaggaaacgcggaacggctggccacgaatacgtcgtggaactcattgatgacccgggtattcatgttgccggccagggctgagttgggataattggtcacaatgaagtcggcctgtccgttttccaggaaacgggcgcactcaatggaagtctggttggtgaccttgatatggatgttggggaattccttgtggaaacggttcaggtagggcaccagataatagcggcagatggtatcgctggcgccgatgcgcagctggcccccgtttaatgtgtgggcttccagaagctggttctcgccccgcttgatcaggttcatggctggctcgatatgttttaacaggatctcgccctcgggcgtgagctgtactttttttgtactccgtatgaaaagaggctggttcagctttttctccaggacttttatggactggctcaccgctgactgggagatgaacagctgcttggacgcctcagaaaaactcagtgtaattgcaacatggtaaaatactttatatagttcatagttgatatccattattaagtcctccttataaactaagcctatcttatcacgatggacaagtgtttgtaaagaggtttctgtctgattgcttgacttatataagtggatggattatcctaatacatatcttgaaaggaataaggattgatatggcagagaatttttatgaaatgtacctggaagagatgggcggcatcgcacctttgacaggccaggagaaaccggaccttctgaaggagacggcaaaggggaatgccggggcgcgcaaccgcttggtggaaggcagtttaaggcatgtgcttgatctggcggcggagtatgagggcagggaacttcccatgtctgatattgtccaggaagcgaacacggccctgatgctggcagccattgaatatgacggaagtgaggagtgggacagccttctggcgcgcagggtaagggaggccgtggagctggcccttgaggagcagaaagcagaagctgagattgaggaaaccatggccgccagggtcaatgtactccagaccgtatcccagatgctggccagggaactgggccgggaggccacgctccaggaactggcagccaagatgaagatgacggaagatgaaatcaaggatatcatgaagctggccctggacgccctgacggtcaatggggaagggcaggcttttgtggatacggaagatgacacggattcctccaatcccattaaggatggatggagcatggaagaactgtagggggagcagagtcatgaagttatatattatacgccacggacagacggactggaacgtggaggggaagatacagggaaggcaggatatcccgctgaatgaaacgggccgcaggcaggccctggcattggcaaaaggcatgaagtcccgcccggtgaccgctgtctattccagcccccagaaacgggccatggagacggcaaaggccatagcagcacccatgggcctgacggtcagggccgtgccccagctgatggagattggatatggggactgggaaggccgcagcgccgaggatatcctgaccacggacagggatctgtatgagtcctggtggcagcatcctgcaacggtggcgcctccgggcggcgagacgctgaaccaggtggacggacgctgccgccaggcgtgggacatgatacgcgcagggatggatggggacacggcggtggtggcccatggggggaccctggcccattttatcgtacatcttctggagggacagccggaagcgaaggaaatcgtggtcagcaatgcaagcattaccaccatggattatgaccctgtatccggcgcctgccgccttgtggacctgaatgactgcagccacctggacgggtgcaataaaatgggatgaatcataaaaaagtaccgcggatgtattgtatttcctggggctttgtattagaatagagatagttttgtaagcgcttacaattaaatatgggaggtattcttatgacagaggttaaaggcaatgtaatcgtaggacagtccggagggccgaccgcggtaatcaactccagcctggcgggggtctataaaactgccaaggacagaggggcaaggaaggtatacggcatgcttcacggaatccagggactgctgcaggagcggtatgtggacctgtccgaccacatcaagacggatctggacatcgagcttttgatacggaccccttccgcctatcttggctcatgccgtttcaagcttccggagatatgtgaggacagggctgtctacgataagatatttgaaatccttaacaagctggaagtggagtatttcttctatatcggcggcaatgattccatggataccatcaagaagctgtccgactactccttgttgaatggcagcaggatccgcttcatgggggtgcctaaaaccattgacaatgaccttgcggcaacggaccacacacctggatatggaagcgcggccaaatacattggcgccataacaaaagaagtgatcagggacggccttgtctatgaccagcagaacgtgaccatcctggaaatcatgggacggaatgcaggatggctgaccggggcggcagcgcttgcaaagggcgaggactgcgaggggccggacatgattttccttcccgaggtcacctttgacgtggattccttcatgaagaaggtggaggagcttcaccggcgcaagaaatcggtggtggttgccgtgtcagagggagtgaagctggcggacggccgttatgtctgtgaactgacagaggggattgagtttgtggatgcctttgggcataaacagctgacagggacagccagatacctggcggagaaaatcaaccgggaggttggctgcaagacaagggccattgagttcaactcccttcaaagatgcgcttcccatattgtctccagggtggatatcacggaggcgttccaggtgggaggggcggccgtgaaggaggcctttgacggtgagactggcaagatgatcatcctcaagcgcgtttccgacgatccctatgtgtgcgtcacggatatctatgacgtacataaggttgccaatgtggagaaaaaggttcccagggagtggatcaataaggatggggattatgtgacggaagaatttgtgaattacatacggcctttaatccaggcagagcttaccccaatcatgacggacgggcttccaagacacctgtattacacggatgtggagaagaagtagcggatggtaaaataaaaacagggcttcggccactggctttccagtggggccggggccctgttttaatccatgcatctcaatccatatattttaatccatgtatcgtaatccatataccttaatggtacagcttcttatgttcatagaccggttcggatgtaagctccacgcccagctttttaaacaccttgatgtccacgtcggacagcatgaccgaggtgtggacctggcagccccgcagtttggggagctgtgacagggcctttttggctgtgtcgtccgtggccgcgctcatggacagggcaatcaggacctcgtccgtgtggaggcgggggttcttgctgcccatgtaccgggtcttaagggtctggataggctcaatcgcggatggggcaatcaggtgtacattgtgcggaatgccgcccaataccttgatggcgttcagcagcagggcggcggaagcgcctaaaaggctgctggtcttgccggttaccagctgtccgtcatccagttccatggccgccgcaggagcgcccagcttctgggcacgttccaggcagggggcgatgacgcggcgcatggcagtggtgatcttggcctggttcatgaggaggttgatcttgtagacctcatcctgatccccttcctccatggcaagacggttcagcgcatggtagtgacggcggatgatttcctggttggatgcctcccggcaggcgtcgtcgtcaatgatacagaagccggccatgttgacgcccatgtccgttggggatttgtaagggctggtgccgtaaatcccttcgaaaatcgcattgagcacagggaagatatccacgtccctgttataattgaccgttgtcttgccgtaggcttccagatggaaggggtcaatcatgttcacatcgttaaggtccgccgtggcagcctcataggctaggttcaccggatgctttaacggaaggttccagatgggaaatgtctcaaacttggcatatccggccttaatcccgcgcttgttctcatggtagagctgggaaaggcaggtggccatcttgccgctgccgggtcctggagccgtgatgatgaccaacggcctggttgtctctatataatcgttcatgccaaagccggcatcgctgacaataagggggatattgctgggataaccctcaatgcagtagtggcggtatacccggatgcccctgtgctctaacttggccttgaactggtcagcgccgttctgtccgctgtactgggtaatcaccacgcttcccacatacagtcccttgtccctgaattcctggatcaggcggagcacatcctcgtcataggtaatgcccaggtcatggcgcaccttattcttctcaatatcagccgcattgatgacgatgacaatctcggactggtcggccagctgaaggagcatacgcagcttgctgtcaggggcaaagcccggaagcaccctggaggcgtggaaatcgtcaaagagtttgccgccgaattccagatacagcttatcgccaaattcaccaatccgctttttgatgtgttctgactgcatggtcagatatttttcgttatcaaatccgattttcatttcttctgtattctccctgtcctaaaattaaccacataccgttttagtatagcacaatttaattgtgtgcgccataatagtttccacggaatctgaagatgatatacggattcatgatatacggattctcatgatatacggatgattggctggatacatccaggatgcaggggattgtttataagaaaacacgcaataaaagattaaatatattaattttactaatttatacggcgtgtgttatgataaggacagataaaaaggcgtcagccctttttggttatatcaataaagaggtcacgaaaaaagcaggaggttgctaaatgagcgtaaggcgaatatttgtggagaagaaaccggattatgcagttaaggcaggtgagctgagggaagagctggaaagctacctgggcctggatgtgaggaatgtgcgtgtcttgatccgttacgatattgagaacctgtcagaggagacatataagaaggccctggggaccattttctccgagccgcccgtggatgaggtatatgaggaggaattcccgaagaatcctggggaccttgtgttttccgtggaatacctgccggggcagttcgaccagagggcggattccgccgagcagtgcgtcaagctcttaaaggaggacgaggagcctgtcatccggtccgcaaccacctatgtgattaccgcgcccctgagcgcggaccaggaagctgccatcaaaagcttctgtatcaacccggtggacagccgtgaggcaggggaagggaaaccggaaaccctggtgactgagtttgaggtgccggaggatatcaaggactttgacggctttacggacttttcccaggaggagttaaaggccctttatgacacgctgaacctggccatgacctttaaggatttcctccacatacaggcatactataaaaaggaagaacacagggacccgtccgtcacggaaatccgggtgctggacacatactggtccgaccactgccgacacaccacattttccactgaacttaagaacgtaagcttcacggacggggattacagggagcccattgagaagacctataaccagtacctggcggacagggaagtgatatataagggacgggacgacaagtatgtctgcctgatggacctggccctgatggccatgaagaagctgcgcagtgacgggaagcttacggatatggaggtttccgatgaaatcaatgcctgctccatcgtggtgcccgttaaaatcgacggggtgacagaggagtggctggtcaactttaagaatgagacacacaaccatcccactgagattgagccttttggcggcgcggccacctgtctgggcggagccatccgcgacccgctgtcaggccgtacctatgtgtaccaggccatgcgtgtgacaggagcggcagacccgacccagccattaagcgggaccctgaagggcaagctgccccagaggaagattgtaaacagcgctgcccagggatattcctcctacggcaaccagatcggacttgccaccggatatgtaaaagaggtttaccatcccggttatgtggcaaaaaggatggaaatcggcgcggtcatgggcgctgccccaagaaaggatgtgatccgtgagacttccgacccaggcgatatcatcatccttttaggcggccgcacgggccgcgacggcatcggcggggccaccggttcctccaaggtccataccacggcttccattgaagtgtgcggcgcggaggtgcagaagggaaatgcccccacggagcgcaagatacagaggatgttccgccgtcctgaggtgagccgtcttatcaagaagtgcaatgactttggcgcaggcggtgtgtcggttgccatcggtgaactggctgacgggcttaagatcgatcttgacaaggtgccgaagaaatacgcagggttagatggaacggaaatcgccatatccgagtcccaggagcggatggcggttgtggttgacccggcggatgtggaccgtttcctggcctatgctgccgaggagaacctggaggcagtgaccgtggcagtggtgacggaagatgcgcgtctggtgatgagctggagggggaagaccatcgtggatatcagccgcgccttccttgacaccaacggcgcccaccaggaagcagacgtgaccctggaagtgccaaaccgtgaaggcaatctctttgagcgcagggagcccggggatgtgaaggcaaaatggatggaaatgctggccggactgaatgtgtgttcacagaagggactggtagagcgttttgacggttccatcggggccggatccgtgttcatgccttacggtggcagataccagctcaccgagacacaggccatggttgcaaagctgcctgtactgaagggacacacggacacggtcaccatgatgagctatgggtttgacccgtacctttccagctggagcccgtaccatggagccgtatatgcggtgctgtcctcggttgccaagattgtggccgcaggcggtgactacagcagaatccatttcaccttccaggagtatttccgcaggatgaactcagacccggccagatggagccagccttttgcagcccttctgggcgcctacggcgcgcagcttggactgggccttgcatccatcggcggcaaggacagcatgtccggcacctttgacacggaggaaggggaaatcaacgtgccacccacccttgtgtcctttgcagtggatgtggacagcagcaggcatatcattacgcctgagtttaagaaaccgggcagcaagatcgtggaattcaggattgcgcgggaccagtatgacctgccggattacgcccaggtaatggagggttacaaaaagctgcgtgaggatatactggccggcaggatcatctccgcctatgcagtggaaggaaacggcctggcggaggcagtgagcaagatggcattcggcaataagctgggtgtgaagatagagcacaatgtggaccccagggacttcttcggggccggctggggcaatattgtctgcgaggttgcggacggtaagacaggggagctttccatctcctatacggttatcggtgaggtcacggacagcggcgtgtttgagtacggaggcacggtcatcaccatggacgaggccctccatgcatggacccatacgctggaggacgtattccccaccgttacgggcaaggcggcctgcggcagcgaagctgtcctggaagagaagctttaccgcacggatgcagtatatgtgtgcggtcataagctgggacagcccaccgtgttcatccctgtgttcccgggcaccaactgcgagtatgacagcacgaaggcatttgaacgggcaggggcaaaggtggttacgaaggtattcaggaacctgggcgccgaggacatccggcagtccgtggacgagtacaggaaagccatagcaggtgcccagatcgtgatgttcccgggcggcttctcagcgggcgatgagccggaaggttcagccaagttctttgccaccgtattccgcaacgcagtgatgaaggaggaactggaaaagctgttaaatgaacgtgacgggctgatgcttggcatctgtaacggcttccaggccctgattaagctgggcctggtgccggagggcaggattgtggagcagggaccggattcccccaccctggccatgaacaccatcggacgccatgtctccaagatggtatacaccaaggtggtgaccaacaagtccccatggctggctggcgcagagcttggcggtgtgtactgcaaccccgcatcccacggcgagggacgtttcgtggccaatgggtcatggctccacaggctcatggccaacggccaggtggcaacccagtacgtggacgacaagggcaatatcaccatggacgaatactggaatcccaatggctcctacatggccatagagggcatcaccagcccggacggacgtatcctgggcaagatggcccactccgagcggcgcggggaggcggttgccatgaacatttacggggaacaggatatgaagatattcgaatcaggagtaaaatatttccagctgtaaatcagcagcttattcagagtgattttcagacacgcttcaggacaggatatgaaaacagggaatacccggctggcatggttccagccgggcattccctgtctgtcgtgggggagtgcaggaaaatcctaaagcactttatggtatgccagcctggggtcccctttttccgtcccttcctgcaggatcaggctgccgcagaggcggtaaccgcttttctccagcgcatgctgcatggaaaggttgtccggatgggtgtcgatccgcacattgtgcaatcccctggccctgacatggtcttctgattctgcgaacagcctggcggccagcccctggccctttcggctttcctccacacatacgcggtggaaggcggcgtatgggccatcattgagccatgcgccgtctatgtccttatagctggcttccggcccccggaccacggttatcattccgatggcctgtccttcttcatccagcacatggacggtcttttggccaatggccgcaagaagccccggcccatccgggtcccccttctgccattggtcgatgccccgtgcccggaaagattccttggcctgctccaccatggaaagaagcctgggcaggtcatttttgtctgctaaacggtatatcatgtgctacctccctgattctgggtttgatttaagttccggccggtcaggataccggcgcgtattccataaagccagtatatagaaaaacagcagcatccgcaaccataagtttgtccgacggacaaagcggggagcgccaatagccaaaattgagaacgcccgcagccaggatggaaccgccccaacaccgtcttgattttttgcatcagggtgctatactggaaagtagcattttcccggatccagattggattcagaaacacgctccagcaaggaccgggcaggaaggagactacgatatggaaacaaaactgaccagagaacaggcactgaaggccctgaagcagtacaacaaggagccgttccacatccttcatgcgctgaccgttgagggcgccatgagatggtttgcccaggaccagggctttggggatgaggcggacttctgggggcttgtggggctgcttcatgacattgactttgagatgtatccccaggagcactgcatcaaggcgccggaactgctgaaggaggcaggggcaaaggaggacttcatccgtgcggtctgctgccatggatacggcatcatggtggatattaagccggagcaccagatggagaagatcctgttcgcagtggacgagcttacggggctgattggcgcggctgccaggatgcgcccgtccaagagcgtgatggatatggaggtatccagcctgaagaaaaagttcaaggataaacggttcgcagccggctgttccagggacgtgatccaggatggggcgaaggaactgggctggaccctggaggaactgatggaaaaggccatctttgccatgcgttcctgcgaggcgtccgtgaatgagcagatggaacagctggaagcttaagggatggatggaccccatattcctttgtgcagatgaggttgggacaatttgcaagaaaaaataggatacatattgaaaagtgtcaatgaatatcttataattagggtgaatcgttggataacttgttgcacattgagaaagaaggggtgttatgtatgctatgtattatgtggctatcggttcgctggccgcactggcttttgccgcctgtatgtttttcagggttaagaaggaacccggaggcagcaaagagatgctgggtatctccagcgcggtacagaaaggtgctaatgcgtatctgaggcgtcaatacaaaggcgtaggaatattttttgccgtggtatttgtcatccttatgggaatggcaatctgcggctttttgagtttttttacaccttttgctttcctgacaggagggtttttctccggactgtccgggttcatcggcatgaggacggctaccatggccaactgccgtaccgcccagggcgcttcggaaagcctgaacaaaggcctgagggttgcgttttcagccggttccgtcatggggtttaccgtggtcgggctggggctctttgacctgactgtgtggtattttatattgaacatggcctttggcgccctgcctgagggggaacggattgcccagataacagccaacatgcttacctttgggatgggcgcgtccagtatggcgctttttgcaagggtaggcggaggcatattcaccaaggccgcggacgtgggggccgacctggtgggcaaggtggaggcgggcattcctgaggatgaccccaggaacccggcagtgattgcagataatgtgggggataacgtgggcgatgtggccggaatgggcgctgacctttacgagtcctatgtggggtccattgtctccacgtccgccctggcggtggccgcgggttacggcgtcaagggggtggctgtgcccatgatgctggctgccctgggcgtgattgcatccattgcaggaacattttttgtgaacacaaaggaggacgcgacccagaaaaacctgctgacagccctgaggacagggacctatatcagcgccgtgctggtggtgctggcagccttttttgccatccgcatcctgcttccgggacatatgggtgtgtatgcagccatcctgtccggcctggcggcaggtgtggcaatcggcgccatcacggaatattatacatcagattcctatccgccaacaaggaagctggctgcctccagtgagacaggaggggccacggtaatcataagcggactgtcactggggatgatgtccacggtggcccctgtcatcattgttgggatttccgtgctggtgagctatttctgcgcaggcgggaagggggactttaacgcagggctttacggggtaggcgtttccgccgtgggaatgctgtccaccctgggcatcacccttgccacggatgcctacggcccggtggcggacaatgcgggcggcatagctgagatgacccacatgcccggggatgtcaggcgcaagacggatgccctggactcccttggcaacaccacggctgccaccggaaagggatttgccatcggttccgcggcccttacggccctggccctgattgcatcctacattgacaaggtaaggcagatcgcgccgggactggatctggacctgtccatcaccaatcccccggtgctgatcggactgttcatcggcggcatgcttcccttcctgttcgcatccctgaccatggaggcggtgggggaggcggcccagtccattgtggtggaagtgcggcggcagttcaaggagattgccgggctgatggaaggaaaggcggagccggattacagcgcatgtgtggatatgtgtaccaaatcagcccaaaggcttatggttgcgccggccatggtggctgtggcggttcccgtggccgtggggcttttgctggggcctcagggcgtggcagggcttctggcgggcaacacggtgaccggctttgtcctggccgtgatgatgtccaatgcaggcggtgcctgggataatgccaagaagtacattgagggcggcgcttacggaggaaagggaagtccgcagcacaaggcggcggtcatcggcgatacggtgggcgacccctttaaggacacctccggaccgtccatcaacatcctgatcaaactgacatccatggtgtccattgtgtttgcagggctggtggtggcggtgcaccttttgtaggattgactggggatgcatatagggctgcggggtatgtccgcgctggctgtgcctgtggatatgcccaaaaccgtggctggattcctatggcgggcagacatttttcataaagaaagtccgtcctgtaaaaacaaatgtcctctgtacacaaattttttcatcgaaacctattgacatccttgataaagtaaggtattatttgcacttgtaacgcagtaaaggccagagcgtgttttatttgttaggatttgttatggatagaggcagtgcaaagtaagagcaagggagacagatacgatgaaaaaagtggtgaagttcggcgggagttcattggccagcgcaaggcagtttaagaaggttgcggatatcatcagggctgataagtccaggagatatgtggttccttccgcgccaggcaagcggagtgataaggatgagaaggtcacggatatgctgtacgcctgctatgatgcagtggcagaaggcaggtcctacaagaaaatccttgagaaaatcaaaagcaggtacatggatatcattgacggcctgaacttaaacctgaacctggaccacgaatttgaacggatagaggagaacttcctggcaaaggcaggaagggattatgcggcttccagaggcgagtacctgaacggtattgtcgttgccaattatctgggatttgaattcattgatgccgcggaagtgattttctttgacgataacggtaattttgaggccgacctgaccaataaggaactgtccgagcgcctggagcacgtggagaaggctgtcattcccggcttctacggttccaggcatgacggcacggtcaagacattttccaggggaggttccgatgtcaccggctccatcgtggcaaaggccatccatgcggatatgtatgagaactggacggatgtgtccggcgtgctggtcacggaccccaggatcgtggatgacccagaggtcattgagaccattacatacaaggagctgcgcgagctgtcctacatgggcgccagcgtgcttcatgaggacgccatcttcccggtgcgcaaggagggcatccccattaatatcaggaacaccaaccgtcccgaggacaaaggcaccctgatcgtggagagtacctgccgcaagccgcgccataccgtaaccggtattgcaggcaagaagggattctgctccatcaacattgaaaaggccatgatgaatgccgaggtgggatttggcaggaaggtcttaagcgtatttgaacagtacggcatttcctttgaacacatgccttccggtattgataccatgaccgtgtatgtgcaccagtccgagtttgaggaatatgagcagtccgtgattgcaggcatccacagggcggtggagccggatacggtggagctggagtccgacctggcattgattgcagtggttggccggggcatgaggtccaaccggggcacggccggaaggatattctccgcccttgcccacgcaagggtcaatgtgaagatgattgaccagggctccagtgagtggaatatcatcatcggcgtgaagaatgatgattttgagacagctatccgcgccatctatgacatatttgtggttacggagctgtgatgtgaatgatacctgcgggaatgggcgcagggttaaaagccagcttggctgaggaatggagtggcacggtgggacaccgtgccactctttgcagatgatcctgcggcattggcctgtggaacgtgcaggcggaggggatggatcttcaggcaggccctctgcccggcgccggacgggaagataaaaatgcaacgccggattaagaggggaaggaacatggggatatggacagcagatgtgataaaaaagcggtagtgaaatacgcgggggcgtttattgcctgggtgattggttccggctttgcaaccggacaggaaatcctccagttcttcacaagctacggctattacagctatggggtggtgatactgaacctgattgggttcctgtttctggggaacatcctgctgaccacgggatatgaccataaaaaggacagcgggttcaaccatttcacctactattgcggaaaaagggcgggggacttttattcctggctggtcctggcaaccttattgctgcttatcgctgtccttgtctcaggggctggggcaaccctgtatgagtattacggactgaaccggtatattggttccctgatcatgtcggcgctggttttaggggcatatctggtcgggtttgagcgtctgatccggattgtgtctgccatcggccctgtaatcatcctgtttaccctgttggtgggggtggttaccgtgatccgtgattttgggaatattacccaggcaggcatgtatggggcggcgctggcagggctgaggccgtcgcccagctggctggtcagctccgttttatacctgtcccttaacttcctcagcggcagcacatattttaccgccctggggatgacggccaaaagcaggaaggatgcaaaatggggtgcggtctggggcgcggccaccctggtcctgtcaattgcaatcatgaatacggccatcctgctccatggagggacagcggcatccctgtccgtaccaaccctttacctggcaaaggaaatctcctttgtgctgggtgccgtgttctccatcgtactggtcctgggtatcttttcctcctgctccaccatgatgtggacggtctgcaaccggattccttctcctcccggagccggaaaacacgggatggctgttgtgatagctgcatttacctatgtccttggcatgcttcctttcagtaaactggtgaacctgttctatcccctggtaggatatctgggccttgtgttcattgcctgcgtcatatacaggggcataaaaggattatttgttctctaatgataaaaaatatggtatactggataaaatagtaaagagcctatggtgatgtgcttcaaaacaaggaggagctgcatatgctggaaaaaattgatttaaataaaaccgtggataagaaatcgtaccgcaaggtgatggacgaggcttcccagaagctggggcttttgcagcgggagtgtaaggcggcggggattccggtcatgattgtgtttgagggcatgggagcggccggcaagggggtccagatcaacaggctgatccagtccctggacccaaggggatttgacgtgtatgcctgtgacaggcccactgaggacgaacagatgcgtcccttcctctggcgttactggaccaagaccccggccaacggcaggattgccatatttgacagaagctggtaccgcagcgtgcaggtggaccggtttgacggactgacgccggaggataagctggctgacgcctaccaggacatcctgtcctttgaaaagcagctgagcgatgacgggatggtcatcatcaagtttttcctgtatatcgataaggaagaacagaaaaagcggtttaaaaagctggacgcttccaaggagacctcctggagggtcacaaagggggactgggagaggaacaaacagtttgaccattatctcaggatgaatgaggagatgcttgagaagacggacacggattatgcgccctgggccatcattgagtcggtggacaaggattacgcggccaccaagattgtgtccgctgtcatggacaggcttcagtacgaactggaaaaaaggcaggctttggcagatgataaggcagtaaagacagcgccggccacaaccaggcagcgcttcaagaacggcgtgctgtccggaatcgacatttctaagagcctgacggaagaagaatacaaggagcaggtgaaaaagcttcagaagcggttatcggaactgcacagtgaactgtaccggttaaggattcctgtagtaatcgggtttgagggctgggatgcaggcggcaagggcggcgccatcaaacgtctgacaagccagctggatcccaggggttacagggtgaaccccacggcagcgcccaatgacatagagaaggtacatcactatctgtggcgtttctggaataatgtgccgaaggcaggccatattgccatctttgaccgcacctggtacggcagggtcatggtggaacggattgagggcttctgcagtgaggcggagtggaaacgggcctaccaggagattaacgagatggaatcccacatggccaacgcaggcgcggtggtgcttaagttctggctccatattgacaaggacgaacaggagcgcaggttcaaggagcgccaggcagaccccatgaagcagtggaagataacggacgaggactggcgcaaccgtgagaagtgggacgagtatgaggaagcggtcaacgagatgctggtgcgcacttccaccacctatgcgccgtggatcgtggttgagggcaatgataaacggtatgccagggtgaaggtcctaaagacggttgtggatgccctggaaaagaaaattaaggaagtaaaagaaaaaagatgagtgatacaaaagagataatagtggcaggcggcggggcggccggcatggttgctgccattgccgcggtaagggaaggcgcacacgtgcacctgtttgagaaaaatgagaagctgggcaagaaaatcttcatcacgggcaaggggcgctgcaacgtgaccaatgcctgcgacatggaggaaatgctggcagcggtcgtgagtaactccaagttcctgtacagcagcttttacgggtttacaaaccaggatatgatgcagctgctggaacaggccggcctcaggctgaaggtggagcggggcaaccgcgtattccctgagtcggataagtcatctgatgtaatcgcagccctttcttctattttaaggaaggagggggtggaaatccatctgaaccataaggtggagggcctggtggtaaaagacggtatgtgcaggggaatccgcgtgggcggccgcgtgtgggacggggaccgcgtgatcgtgaccacaggcggcctgtcctatccgtccaccggatccacgggcgatggctatggatgggccagggaaagcggccataagattacagacctgtccccggccctggtggcctttgagacaaaggaagtggatacggtaaaggaactgcagggactttcccttaagaacgtggaagcagccgtatacgacggcaggaaagagctgtaccgggattttggggaaatgctgttcacccatttcggggtcagcgggcccctgctcctgagcgccagctcatatgcagccaaggccatcaggaagcagcccctgcggctggccatcgacctgaagccggcgctttcaagggaacatctggatgacaggatcctgcgggacttttcagagagtaagaacaggcagtttaaaaattcactgacccacctgtatccggccaagctgattccggtcatcatccggcgcagcggcattgacccggataaaaaggtcaacgaaatcacaaaggaagagcgggccaggctggtgcaggccaccaaggaactggagtttaccctcacaggcctcagggattacaaagaggcaatcattacccagggcggtatttcggtccgggatgtgaatcccgggaccatggaatccaaacatgtccgcggtctgtactttgcaggagagatactggacctggatgcggttaccggcgggtttaacctgcagattgcatggtccacaggctgggctgccggcaaaggggctgccagggaggcttagccggcagaagcagtttccggacacggcccgggagataaaaagacaggagaggaactggatacatgggacattttaacatagcagtggacggtccggcaggagccggcaaaagtacaatcgccaggatggtggcaaagaaacttggattcgtgtatgtggatacaggcgccatgtaccgtaccatggcattacattttatcagactgggaatcggttcaggagatgaggaagccattgcccgggcatgccgggatgtggatgtgaccatctgctacgaggatggggcgcagcaggtcatgctgaatggggaaaatgtctccggccttatccgcaccgaggaggtgggcagcatggcctcggctacctccgtgtatgcgccggtgaggaagaagctggtggaacttcagcaggaactggcaaagaaggcggatgtaatcatggatggcagggatatcggtacctgcgtgcttccggatgcacctgccaagatatacctgaccgcctcggtggaggtacgggcaggccgccgtttcaaggagctgacggaaaaaggcgtggagtgcagcctgaaggagattgaggaagacatcagggaacgcgattaccgggatatgaaccgggaacattccccgttaaagcaggcagaggatgccgttatgttagacagttccgcgatgaccattgaccaggtggtggatgccattatccgtattgcctgtgagcgcggcctggaggtgggcgcgtgagccgggaagggacagggcgccaggtagtggtggcgaagagcgccgggttctgttttggcgtggaacgggcggtggaccgggtataccagcagatagacgccctgaaggcggggaaggccaaagggcctatctacacgttcggccccatcatacacaacgaagaggtggtaagggacctggaggaaaagggggtcatggtgctggaggacgaggctgccctccggtcacttccaaagggacaggggaccgtgatcatccgttcccacggtgtcagccgtcacatttatgatatccttgaagagcggggcgtggagatagtggacgccacctgtcctttcgtgaagaaaatccaccgcattgtgtcggagcactcggaggcaggggacgcggttgtgatcataggcagcccggaccatccggaggtggaaggaatcaggggctggggaaatgagtataccacggtcataaatgatggggcgggggtggatatctatgtgcttccccagggcaaaaagctttgtatcgtgtcccaaacgacatttaattacaacaaatttaaagaattagttgaaaaatttttaaaaaagggttatgatagtagtgttttaaatacgatttgcaatgcaacacaggaaagacaagtggaggcggcgaagattgcttctcaggtagacgccatgattgtgattggcggaaggcattcatccaatacccagaagctatttgaaatttgcctcaaggagtgtaagaatacgtcttacattcagacactcggcgatttagatcctgatagtgtatcttctgtgcgcagcgtaggtattacagctggggcatccaccccaaaaaagattattgaggaggttcataccagaatggcagagcagagttttgcagagttattaaaggaagaggaagaatcaaccaaaccaatacgtacaggagagatagtcaccggtcaggtcatcgaagtcagcaaagatgagattatactgagtattgcagggaataagtcggaaggcgttattacccgtgatgaatacagcaacgacagtaatgtagatttgaccaccaaagtacagattggtgaggagatggaagccaaagtcattaagctgaatgacggtgtaggcatggtttcattatcctataagcgtatggcagcagacaggggcaacaagcgcctggaggaagcatttgagaaccaggaagtcctgactgcaaaggtagcacaggtattggacggcggcttaagcgttgaggttgagggcgcaagggtattcattccggccagtctcgtatctgacagctacgagaaggacctgtccaagtatgcaggacaggatatcgagttcgttattaccgaattcaatcctaagagaagaaggattattggcgacaggaagcagctgctggttgcacagaaggcacagctgaaggaagaactgttttccaggatccagattggtgatgcagtggaaggaaccgttaagaacgtaactgacttcggcgcattcattgacctgggcggcgctgacggactgcttcatatctctgagatgagctggggccgtgttgagaatcctaagaaggtattcaaggccggcgaccaggtaagggtcctgattaaggacatccagggcgagaagattgccctgagcctgaagttcccggaggcaaatccatgggtacaggcagctgagaagtatgcggttggcaacgtggtggttggccgtgtggcacgtatgactgatttcggcgcatttgttgaattagagccaggcgtggacgcactccttcatgtatcccagatttccagggagcatgtggagaagccttctgatgtcctgaggattggcgaggagattgaggcaagggtcgttgatttcaacgaggcagaccacaagattagcctgagcatcaaggccatgatggcaccggtacagcaggatgcggatgtggctgatgtggacatcacacagtacacagaagaataatgcaatcagtccgcggtgaaagcatcgtgggaatgtgcaggagtattaagggactggctatggacgcggtaagcgcccatagccttttttgaattgtcagggggagattggtcagggggaaattgatgattgtcaggggcggattgatacatgaaaaatcaggaacagggttatttcatcaatggattcagaagcagggatgcctcaaaaatcccattttcatacgtgaatttaaggatgccgtgataccgctccacaagataacgcacagaggaggtcccggtacccaggtcatcccgtttggaggacaggaaacgtccgtccttcaggcggatggcgtgggtataggtgttgcggatggaaagggcaatcatggatttacccgcctgcccgatattgatggcaatggaggggataccggatgtctggcgttcgcaggcttctactgcgttggagagaaggttgcccaggattgtgcagaagtcggtgtcgggcatggggagagcctcgggcagggagatggaggtttccacaccgatgccctgattcctggccaggtggatataatagtttaaaatggcgttggaggagatgttggagcaatactggaccgtggaaagggcctcgaagctgcccaggtattcattgatgtattccagggcgcaatccggtttctgttcctccagaagcccttttatggttatcaggtgatggcggtagtcatgccgtgtttttttcagctggtccaggttatactggagggtagccatctgggaggtctgcacgccggcaaggagacgggtggtcctgtactgctcactggcagcatagctttgggccagcctggaaagtatacgtaaagttacgtagtgcacggtgtagatacataccatccagcagataacggaaaagaaggcgttggtatgggtggccatgaactgctttggtgtgatatatcccacatcaaagtgatatacgacgaagaacaggacagggatcgaaaccaggcggctccacaccggaagggggcgtgtgtattccacggcctggatcaggtgtccgtgcagcagataatatgcgctggaaacaataagggtgaggaagagaagctggtacgcaaaacctgcgctggatatggtggccgtatttgccgggatattccatgagatatccagcatgcctgcaatgaacgtggatatgtccacaaagttcttgaacaggaacagggaatagacggtgaccttcagatctgttttcaccatccatctgcagaccaggacatgtgacagcatgatgatgcagctccatggaagataaatcctttccctggaaaacttcaatgccgcacaggtgaggaggcacacaaaaaaaaggtatcccaagagaatacctgtaattttagacgcagaatacctccattctttgcggaacgtaaagaggaagggaaggatgacatatagtaactcagccaggatggtgcataccagcaggatattgacaggatacatcagatacctccgtttaacttctggaactggtaatcagcataatgctgatggatctgcggcctcagtgtccttgtgattggcagatgctctccggtattcaggacaaactcagccttttccagggatgtcaccttgtccatattgatgatacagttcctgtaacagcatatgaactggggatagcagagcagcaggctggaaaaatcgtgaaaacgcatgtaagtcttcacaagcctgcccggcagatggatctggatgtaatggttgctgtaatccgtgtagaggatatcatcgatgggcagcttgaccatgatccggctttcttttacttctatataatggctgcgcttcctctgggacacggagcggaaatagtccatggtctggcagaactttccgaagcgcagtggctttagcatgtaatccagggcacgcacctcgtatcccttcagggcaaagtccgtactgctggtggtaaagatgatggtgcactggtcatcgtcacgccggatatgctcggcaatccggattccggacgcctcccccttcaggaaaatatcaatgaaaacaagttcatatacgccgatgtgccaggcgttaaggaagtcggctgccgtattaaagatagtggttttctgactgatgtgggcatcggaaaaataagtggacacgaatccggccagctgtcgcgcatcatctatggagtcatcaattactgcgatattcacgttgcgcttcctttctatcatttaatcagggaatcccatgacttttgtgaaaatttaatcaaacaactgtatataatgggacaacagatacaaattcagtataatatacaacaagttaaaaagcaagagtaattggaattagttgtaagagccgtatagggtaccccctgcctgggcataatccttttgtacttatatgaaaggagttgtggacagcatgggaaaagcaaaaaaggcagagccttttgaccctcataagttaagtccccaggaccaactgaaattcgagattgcccaggaactgggcctggattcaaaggtgatggaaagcggatggagaagccttacggcaaaggagagcggccggatcgggggcctgatcacaaagcggaagcgggaaatgaaaaatgaggcattgcaacaggaataaatatctattatactgaaatgtgttcatttcgattcagaggatgccctggaggcgtgtgattggaaaactccagggaagtccttatggtttgtccggcgggggatggctctggcttgtttgacgggggatggtcctgccggactggtacttttatggttattgcgcggataaaagagtccggataaaggagtacgggattgaagattggtataatcagttttacagccagggggaccaggctctgctgccatctggccagcaggttaagcggcggcgtggacgagtgtactgcatttgtgcctgagcgttacagcgatacatatgataagacgggggatatggaaggggttgtaagatgccaggacatgcccctgggccagtggacaaaaaccatgttcctggaacagagggccatggtgtttgtgggggcggtggggattgcggtgcgggccattgcaccgtttgtgcgggacaagatgacagaccccccggtagttgtggtggatgaagcgggccgcttttcaatcccgatcctgtccggccatgtgggcggggccaatgcccttgccagccggattggggaatgcatcggtgcagtacctgtgattacaacggccacagatgtaaacggactgtttgcagtggatgtatttgcagctgagaacggactggtcctaacggaccgggaggcggctaaacaggtgtctgccaggatcttggacggcgggaatgtgggattcttcaatgagtttgagggtggggagccgggcgtgcccaggggctgctgtaaaaatcccagtgaatataatatatgggttacggtaaaggacagcagcctggagtttgaaaggagtgtgggggctgtcggttccctccatgtcctaaggctcattccgcaggcagttgtggcgggagtgggctgccgcaggggagtggagcccttcatcctggaacggcaggtcctggaaggctttaggaaacatgggatagacccagcgtcagtcaaggcgctggcaaccattgacataaagaaggaggaacctgccctgcttgcattggcgcaaaagcggggctggaccctgcggttttacagtgcggctgagcttggggatgtgggcggtaccttcacggagtccgcctttgtggaacagacggttggaatcggtaatgtctgtgagcgggcatgtatggcagaaggaggaaggctgctgtttggcaaggaggctgggggaggtgttacggtggccgcggccgtggagcctttcaaattagacattgagaaatacatatagatatgttatacttttagtttataagtcagaggatagacagcaggtgatacgatgggagactcatacatctataagaatcagaaaaaattgagatggggatataccacgggtacttgtgcggcagcggcttccttggcggctgccgttatgctgcttgggaggaacaggacggagcaggtgtcggttgaaacaccaaagggcataaggctggatttggaagtggaggatatttccatggggcagcgtgctgtttcctgcggcgtgaggaaggacgcgggggatgacccggatgtgacggatggccttgtagtgtattccagggtcagctttggcagggaagaagatggcccggatgatgtggggaaacatgccggtgggtattatgaacataaaaataatgatatttgcctcaaattaacaggtggggtgggagtgggacgggttacaaaggaaggattaagctgcgaagtgggaaaatcagccatcaatcctgtgccgcgccagatgattttcagacaggtggaggacatctgtgccagataccggtaccggggtgtgctgtggattgaaatcagcgtaccgggggcattggaggtgtctgggcgtacctttaacagtaagctgggaatcctgggaggaatctctatcctgggaaccagcggcatggtggaacccatgagtgaaacagcgcttttggaaaccatccgcctggagctgcggcagaacgtgctggcgggacattgccggctggtggtgacacccgggaattatggggaggcattcctgagggatcatctgaagattgggcttgaacaggctgtgaaatgcagcaatttcatcggaaacaccattgatatggctgtggaagaaggggcagggggaatcctgttggtggggcatggaggcaaacttattaagctggcggcaggaatcatgaacacgcactcgtctgcggccgatgggcgcatggaggtgctggcggcttatggcgcggcctgcggggctgactcctgtctggtaaaccggattctggaagccattacggtggatgaagggctgcggctgttggaaaccagggaaggcctcagggaccaggtgatggagcgggtgatggaacgtatagagggacatttaaaagggcgtgcagcagggcggcttgagattgaagcagtggtatttaccaatgagagagggattctcggtgctaccagcggggctgccgtgatgctggaacgcattgcagataacctatgatcatgaaaggcggatattctatggtacatatagtaggagcaggcccgggcagcccggacctgataacggtaaggggacaacggcttcttggggaagctgacgtggttatttatgcaggttccctggtgaatcctgagcttctggcccttgcagggaaaggggcggctgtgtatgacagcgcaaggatgacgctggaagaggtgatggatgttgtggagcaatcccaccgggcaggccttgctgttgtgcggctgcatacaggcgacccatgtttatatggggccatccgggagcagatggactggatggacaggaaaggaatcccatatgacatatgccctggtgtaagctctttctgcggcgctgcatctgcccttgggatggagtatacccttccggatgtgacccagagcgtggtaatcaccaggatggccggcaggacgccggtgccggagaaggaatccatacgcagctttgcagcccatggggcttccatggtgatattcctgagcacgggtatgctggaggaattgtcacaggaactgacggcaggcggatacagggaggatacgcccgctgccattgtttacaaagccacgtggcccggggaaaaggtggtgcgctgtaccgtgggtacgcttaaggagtctgcgcagcgggaagggataaggaagacggcgctgattatcgtgggggatagtgtggctcaaagcggatatgaacggtccaagctgtatgaccctgtattcacgactgagttcaggacagggcgggaagatgctggtatgggcaatatcaggccaggcaccatgtatgtggtgggaatggggccggggagcatggaccagatgacaggcgctgccctggaagcgttaaagcgctgtcaggtcattgccggatatacggtttatgtggatttaatccgtgagcattttcctcataaacagttcctgacaacggcaatgacaagggaagaggaacggtgccggagggcactggaatgctgcatggagggcaaggacacggccatgatatgcagcggagacgcgggcatctatggcatggcgggtctgatactggagctggcgggacaatatcccggagtacaggtggaaatcgtgccgggggttacggctgccagcgcaggcgctgcggtgttgggagcgcctttgatgcatgactttgcggtcatcagcctcagtgacaggctgactcctttggatgccatatggaaccgggtggagtcggctgcccaggcgggctttgtcatctgcatgtataatccggccagcaagggaagaccggattatttcaggcaggcatgtgagcggatccttaagtaccggggtgaggatacggtgtgcggccttgtatccaatataggcagggacggacagcacatggaggtgatgagcctgggggaaatgaaggacagggctgtggatatgtttacaaccgtctatataggcagcccgcagacaaggaaaatcgggcagtatatggtaactcccagaggctacaggtatgagggatgacaatgcatggaatgatatggcggaaaagggcagccggataaggcagaaaaaggcagtcctttttgcaggaacaacggaagggcgtctgcttgcagcgtatctggcaggccttggctgccggacggttgtgtgtgtggcaacgaagtatgggcgggatgttctggaggggggaagcccggataacagcaacccggataacagccttctggatatccggcagggccgcctggaccgggagtccatggaggaactgctggaagaagtccggccggggatggtgattgacgccacccatccatatgcaacggaggtgacggagaatattaaacaggcatgtaaggcatttcctcagatccggttcatccgttgcctgagaagggaaagcggtcccacaggtgatgatgtcatccatgtgccggatgtaaaatccgcggttcagtggctggcaggacgggagggcagcatactggtcacgacaggcgttaaggagcttgctgttttctgcagccttccggattaccggcagaggatattcgccagggtgctgccgtccgtggaatccgtggacatatgcaggaagctgggatatgaaggacggcatatcattgccatgcagggaccgttttcaacggaaatgaacctggccctgttaagggagtttcagtgccggttcctggtgacaaaagacggcggaagggccggggggatggatgggaagctggaggcttccagggcggcaggggcacaggccgtgctgattgacaggccggaaagcgccgggggtatttccctggaggatgtaaaaatacagataaaggagtggatggaacatgagagatgagaacacattttcccaggagcttcggccggtcgtgtatctggtcggtatcggtatgggaggggaggaccagctcaccggacgtgccatggactgcctggaagctgcccaggtcataaccggggctgaccggatgcttgagagtgtgcacccttacaccgagggaaagcgtgtgttttccgcctacaagcccagtgagatggtacagtggctgggaagctttaagtgggaggaggcggcgctggtgctttccggcgacaccggattctacagcggtgcggaagcagcagccaaggcattcatgagggaaggatgggatgtggaatatgttccgggtgtgtccagcctgtcctacttttgcgccaggctggggaagagctggcagaacgtccatccaatcagcagccatgggcgggagtgcgatgtggtggcccatataaggaaccacaggtcctgctttatcctgctgggcggaccaggaagcgtgtcctccctgtgcaggcagctggtgagcagcgatatgagccatgtgaatatatgggccggagaaaatctctcatatgaagatgaacgtattacctgggcgatgacgcctgctgaacttatcatggaggatgagcaccggccctttggaagcctggtatgtgtcctggtggaaaatgacgaagcgcttgagggacagctttatccggtaaaggggcctgaggacagtgagttcatccggggacaggttcccatgacaaaggcagaggtgcgcaggctgtcattggaaaagctccgcattggggatggggctgtctgctatgatatcggggcagggactggttccgtggcagtggagatggggctggaaatccggcgcaggggaggcaatggggaggtttatgccattgagcgcagcctggacgcccttcagctgatacagtccaactgccagaaattccatggaggctggcagggcttccatattgtggagggcgaggcgccggaggcaatggacggactgccgatgccgacccatgcgtttatcggaggaagcggcgggaagatgccggcaatcgtggaggcgcttctggcagccaatccacaggtaaggattgtggcaaatgccattacgctggaaactgttggggagattctggactgcatgaggaagttcggattccaggatacggaactgacccaggtactggcggcaaaggtggaagtggttggcgcctatcatatgccaaaagcacagaatccggtttatgttgcagtgatgcagaacccgtctttggacagtgaggagatccaatggcaggagttatgatagctgctcctaaaagcggcagcggaaagaccatgattacctgcggcctccttaaactccttgacaggaaaggatggaacccggcccccttcaaatgcggccctgattatattgacggcctgttccacaacaaggtgctgggattggaaagcgggaacctggacagcttttttgaggaaccggaccatatgcgtgagaaaatttctcacatatctgcagaccgttttgtggtggccgagggagtcatgggttactttgacggtttaggaggaatttccgcgaagggcagtacgtgggaaatctcccagatccttgaactgcctgtcatcctggtggtggatgccaagggagccagcctgtctctggcggcccaggtcaagggattcctggaatatgttcccagggatgaggaaggaaaagaaatcaaatgtgtcaaccggatcggaggtatcctgtttaaccgcatatcccccatgatatatggaagggtaaaggcgctcatagaggaacagctccacgttccggtcatcggctatgtgccggagcttgatttcctccaggtgggaagcaggcacctgggcctggtcctgccggatgagatagacgggcttaagggacagatggagcggctggctgactgcatggaaaagacagtggatctggatgtgctctccatgattagcggcggtaagggagaagcagcggaattaaatcctgggagggggcatcgtgcccggccgggaaaagcggattcaggcagggagcatcgtgcccagcaggggaatccggattctgacagaaatcaatatccgaatccagggaaggcggattccgatgagatgaattgccgtcagatgtggtgtggaaaaagtggaacggtaccttttgcccatggatgtgaaaaaaactcagacagacagttttacctgggcgtggccctggacgaggcgttctgcttttactacagggacaacctgaacgccctggaacatgcaggggccaggctggtatacttcagtcccctccacgatgaaacgataccggattatctggacggcctgctttttggagggggatatcccgagaattatgcaggggaactggctggcggtatatccatgcgttcttcggtggctgatgcggcgggccggggaatgcccatattgggagaatgcggaggttatctatacctgcttgagacattgcagggcattgacgggaaggactatccgatggcgggcgtgctgcccggccgcggcttcaggggagataaaaagggacgtttcggttacatcacccttagcccggacggaacccttccgtacatactgccgggcatggagataaagggccatgagtttcattactgggactgtgaatgcggggatgaggaatacaggatgacagccaggaaaccggtgggcggcaggtcatggcgctgcatgcggaccaggggggatgtgctggctggcttcccccatctttattatccctcctgtcctggatttgcagagcggtttgcagacagatgcatcatatttggaaggaaaatgggacatgaatcttgatgaagtgataaagtcagtaaaacaggctgatgaggcagccgtgaaacaggccctcaggcgctgggaccaggtggcaaaaccccttaacagcctgggtgtcctggaggaggacattgtgcggattgcaggggcatccggcacagccgcaatcgacatcagtaagaaggccattgtggtgatgtgcgctgacaatggaatcgtggaggagggggtgacccagaccggacaggaggtcactgccattgtggcaggaaacatggcaaagggctgttcctgtgtctgcatcatggcagggaaagccggtgcggatgtcatccccattgatgtggggatagctggtcatgaccccattccaggcgtgcttccaagaaagattaaagagggcacgcagaatttcctgaaggccccgtccatgagccgcggccaggccctaagggccatggaggtgggaatcaggcttgcgtatgaactgaaggaaaagggatatgggctggccggctccggggagatggggattggcaatacaaccaccagcagcgcagtgctgtccgtgcttcttgaccaggagccggaggcggtaaccgggcgcggcgcagggcttaccacggatggatacagccggaaaatccaggtcataaaagatgggattgcccttcaccggccggaccggtcagatccggtggacgtgcttgccaaggtggggggatttgatctggcggccctggctggtttttacataggatgcgggatggtacgtcttcctgtggtgctggatggcctgattaccggtgcggcagccctggcagcagttggaatctgtcccagggtcagggattttttgctggcctcccatgtttcggcagagcctgcaggggaaatggtgctggacgccctgggccttcggcctgccatccgggccgggatgtgtctgggggaagggactggggcggctgcactttttccgcttcttgacatggcggcagccgtatacacgcagatgagcagttttgaggaaatccaggtgggccagtatgaacacctggtctgatacatatctgacatcaacggtaccggaacagtattccatgaaatccgaagggaggagtggcctgtgatttatctcgtgacaggcggcagcggcagcggcaaatcagaatacgcggagaaccttgtgatggcctcaggctgccctgtgcgttattatgtggcaaccatgaccgtgtatggggaagagggaaaggcgaaggtcctccgccaccaggaactgcgcaggggaaagggattcatcacagtggaatgccaggcagatgtgggtacggccctgtgcggtatcaggaacagcaatcaggagaaggccatcctgcttctggagtgcgtgtccaacctggctgccaacgagatgtttgcagatgggggggagggacagggaaatgtctccattgacaagctggcagacaaattgctcaaagacatcctctgcctggcatcccaggtaaaggatatggtcattgtgaccaatgaggtggcgtccgacggtatcatatatgattcagggacggcagggtacatacgccttatgggacttgtcaacagtcgccttggggcatgttcccaccgggttgtggaagtggtatatggaatccctgttgtatggaaagggtaaggttaaaaatcctgttatacgcaaaaggataaaggagaggagctgagtaatggtatgaatggaatttattcctgcataatagctgtttccatgtattccaagatccccatgcctgcggtggaatggacagaggaacggatgcgccatgtcatgtgcttttttccatttgtgggactggcccaggggggagtactgggactgtggttttatctggggctggatgtgtttgcactgaatcccctgacggctgcgctgataacggcagccattcctcttctggttacaggcggaatccacatggacggcttcatggataccatggatgccatccactcctatggtgaacgggagaaaaaactggaaatcctgaaagacccccatctgggggcatttgccgtcatatcactggcagtctatcttctcctgtatctgggggtggtgaatgagtacgtgcagtatctgtccggctgcgaaggggattttaggttcctgctttacgtgatgcctggagtggtatttgtgatggagcgggcattcagcggactctcggtggtcacattcccatctgccaaaaaggacgggctggctgctgggtttgcacggaccgcacaaaagcgtacggacaggattgtgctggccgtctggctggtcatatgcctggccgttgcagctgccctgggatggagggcaggcggattggccggggcggctgttttaagccttggcctgggattgggccagctccttgtgttctggtggtattacaggatgtcattaaaagaatttggcggaatcacaggggatctggcaggctgtttccttcaggtgtgtgaactggccggactggctgtgctggcggcgctgttaaagacagggatactgggaggtcatgtcatatgattttggttatcggaggaagaagccagggcaagagggaatttgtccaacaaaaccttataccggaggcggatgcagggacggtccggtgggcgtccggcggggacgggggatgggaatcctatatgaacagcaggtactgctgtgatttccatctgtttatcagacgtctcatgagccatgagcttggggttggagccaacggggatccctggaagcccggggatgaaaaacagatggaagaaatcctgaaagccttgctggaagatgccccggaccggattctggtgacggatgagattggctatgggattgttccggcagatgccatggaacggcagtaccgggaggaaacaggacgtctgtgctgcctggcggcaaaggaggccgatgaggtctggcgggtcttatgcgggctgggacagagaataaagtgactatgctgggacagggagtaaagtgactatactgggacagggaataaagtgaccatatggaggacggaataggaacatggctggatggtttggattatggaaattacatgggatggcgctgcttgcaggatgtgtcctggactggatcctcggcgatccgtatcatttcccgcacccggtccgcatgatggggcggatgattacatggctggaaggatactttaggaaatggatgggcggcagggaactggcagccggttttttcctcacagccgccatgtgcgtggtgtggtgcctggttccgtggggcgtactgtatgcattgcggcagatttcatttccctccctctggatcctccccttttgcgttgagacaatcatctgttaccagatgcttgcagccagaagcctgtgcacggagagcatgaaggtatgccgcagcctggaggccggggatgtggaaggggccaggacccacgtgtccatgattgtgggaagggatacggcggtgctggaccagtacggtattgccagggctgccattgagaccgtggcggagaatgcgtccgacggggtagttgccccctttcttttcatggccctgtttggaccggtgggaggaatgttttataaagcagttaacaccatggactccatgatagggtataagaatgagaaatatatcctctttggaagggcggcggcaaaactggatgatatcttaaatttcattccgtcccgcctgaccggaggccttatggtgctggccgcctttctccttccgggaatggacggaatccatggatggcgcatcctgatgcgggacaggcataaacatgcaagtcctaattcagcccaggccgaggctgcatgtgcaggcgccctgcatctgaggctggcaggggatgcctggtatttcgggacactgcacagaaagccctttatcggggatgatgaccgcccggtgtgtccgatggatattaagaaggccaaccagctcatgtttacagtggagatgatcctgatggccgcgctgacagccatcctggtcctgacatgacctgtacacgatataaaaggtgattatacggaaaaagtattagtggaaataggattttacggaaaacagtgtttgtgaagattcatggaaaataaaatggacaaaaagcagtgtttgtaaaggtttgtaaagaatggcttgagaggagaaccgattcatgcagtatcagcacggcggggatatttacacccgggaaatcgatatggactattccgccaatttgaatcccctggggcttccggacggggtaaggaaggtactggaatcctgtatacatacggatgtgtgcagcgtatacccggacagccgctgcgggaagctgcgggaggcgctgggccggtttcatgaagtgccggaagaatggattatctgtggaaatggagcggcggacctggtgttcggactggtccatgcctgtatgccaaggagaggactggtgacagccccggctttttccgaatatgaacaggcaatggtgacatgcggatgcagggtggaccacctgttcctggaggaaaaggaaggattttcgctggatacggaggtccttctccagcggattacaggggcggcaggggaaggcaggccatatgacatggtattcctgtgcaatcccaataatccaacaggcatacctgtaccggcaggggaaatcagacgggcggcacaggtatgccgtggttatggcacgcgccttatcatggatgaatgcttctgtgatttcctggatggaccggaggcatgctccgtgattccgttcctggaggaataccccaatctttttgtgctcaaggcatttaccaagctgtattccatggcaggactgcggctgggatacggtctttgcagtgatggacacctccttgaacgcctgggtgaggtgaggcagccttggtccgtgtcgggccttgcccaaaaggcaggcgaggcagcccttaaagagcaggatttcgtcagacgtacgagggaagtggttgggacggaacgggaatggatgcgggtagaactggaaaaacttgggtttaccgtatatgactcccaggccaactatctgttttttaaggtatttcaaggaaaaggggatgccgggccggacagatgggatactgggccggacagaggggataccgggccggacaatggagatgccggacaaggcggccccgcagggcgggacatggaaatgcccgcaaaaggctggctgtaccaccggttgttgaagcacaaggtgctcatacggagctgcagcaattatccaggactcaattcctccttttaccgggtctgtgtaaagacaagggaagagaaccaacggctgatggagtacatgacgaaagcagtaaaagaagaaacagggcaaggcgggatggcttaaagtgaacagcacagcccccaaatgaacgaacagaggagaacgataatggcgagaccaatcatgattcagggaaccatgtccaatgcgggaaaaagcatcctggcagccggactttgccgtatattcatgcaggacggatacaggaccgcgccctttaaatcccagaacatggcattgaattcctatattacatcggagggcctggagatgggacgggcacaggtggtccaggcagaggcggcaggcatacgcccccacgtggatatgaacccaatcctgctgaaacccaccacggatgtgggatcccaggtgattgtccatggcatttccaggggcaacatgaaggccagggattactttgccatgaaacgcagcctgattccggaaatcatggcatcctatgaacggctgtccaatgcctatgacatccttgtcattgagggcgcgggaagcccggcggaaatcaatctcaaatcagacgatatcgtgaacatgggccttgcgaagctggtggacgccccggtgctgctggcaggtgatattgacaggggcggtgtgtttgcccagctttacggcaccgtggcccttctggagcaggaggaacggaagcgggttaaagggcttatcatcaacaaattccggggggacaggtccatactggaccccgggaccgcgatgctggaacagctgtgcggcataccggtcatgggggtggtgccctacatggatgtggatattgaggatgaggacagtttaagcgcccgtctggacaatggtcaggcccccggtctggtggacctggcggtcatccgtctgcccaggatatccaatttcacggattttaatgtgttttccaggatacccggggtatccttgcgctatgtttccagggtttcagaactggggacgccggatctggtattccttccgggtacgaagaataccatggatgacctgctgtggatgcgccagaacggcctggaggccgcagtgcttaagctggcccataaacaggtacccatatggggaatctgcggcggataccagatgctgggagaagtgctcagggatgtttccggtgtagagtccgcaggcggcagggaggttgcaggtatggggctgctgccgctgaggactgagttccaggaggaaaaggtaaggacccaggtggaaggttccctgggagaactggacggtgtcctggcgcccttatcaggcaaatgcatcagcggctatgaaatccatatgggccgcacgtccattgaccgggaacatggggccatggataccgcaatgctggtgtcctggcgccgggaacccgtcatctgccgcccggcctcctatgtgatggaggtacaggatacggatcagcagggctgtgagaggaaacgggtgaaggaggacggatggaaccgggggaatatctacggggcctacatccatggtatgttcgaccatccggggatagcggagacgattgtatcctcactggcggcacggaaagggatatccatggatgaggtcagggaaggggattatgaagcctaccggcagcagcagtatgataagctggcagatgtactgcggtccagcctggatatggatgccatttataagatgatggggttatagggcgcggaaagaccgctttttaaggtaatggcggcaatggacccgtaacagaccaatagcagaccggccatgggatgtcagacgaaatagtaacagaccggcagcaggggctttgggataccatgctccagactgccatataaggagacaagacagaatgttaaatatacaattggaacaggtgcttccctcggagatagagcgccgcagttttgaactgattgaccaggagctgcaatccatgggaatccgcctggagccggaacaggagccggtcatcaagcgggccatccatacaacggctgattttgagtatgccgggaacctggtgttctctgaacacgcggtgcaaaaggggattgacgccctcagacagggggctgtgatcatcacggacaccaatatgggatggtccggggtgaataagaagaaactgtcttccctgggaggggaagcgctctgcttcatggcagatgaggacgtggccagggaggcggctgaaaaggggaccaccagggcagtggccagcatggagaaggcggcccggttatttggaaggaaccgtccctgtatctttgccatcggcaatgcccccactgccctgatccgtctttatgaactggtgaaggaggggagcattaccccggccctggtcataggggcgccggtcggtttcgtgaacgtggtccagtccaaggaactgatcctcacgcttggggatacgccctacatcgtggcaaaaggaagaaaggggggcagcaacgtggcggccgccatctgcaatgccctcctttatcagattggatgattgggtaaatgatttatttttttccgttccagcagtaggtgcagagcttacatggggaaatgccgatggattccaccaggtcgtccagcctgtggtagcggagtgtggtaaagttaaggcgtttcctgatttcctccatcatttccttgtaattaccactgtccgggttggcatagtctgccagcagttcatctgatacgcagtcaccttcccggtccttgatgatacgtctggtaatcaggtccagctccgaggaggagcgggagaaattaagataggggcagccaaacatcaggggcgggcaggcgggccggatatggacttcctttgcgccgctctggtataggaattcagaggtttcgcccaactgggtccccctgacaatggaatcgtcaatcagcagcagttttttgcctcggatcagcgcgtccacgggaatcagcttcattttcgcaatcaggttgcgctggccctggttctggggcatgaaggaacggggccaggtaggtgtgtatttgatgaaggggcgtgcaaaggggatgccggattcattggcatagccgatggcatgggcgattcccgaatcaggtacgccggccaccacgtcaggccttgcctcgtcccgtttggccagaagctttccgcattcatagcgcatgctctccacgttcaccccctcgtaggtggaggtgggatagccgtagtagacccagaggaaggaacagattttcatctcctgtcttgggggactcatggtttccactgattccggggtcatgaagacgatttccccggggccaagctccttgtagtcggagtagcccaggttgataaaggcaaaactctcaaatgaggcgcagaaagcgtcctccttttttccgattacaacaggtgtcctgccgtatctgtccctggaagcgtagatgccttttggggtcagcagcagtatggtcatggagccctcaatccgctcctgggcatacaacagcccttccaccagggaagacttctggttgatcagggcagccaccagctccgtggaattgatgcgcccgtgactcatttccataaaatgtatatgtccgttcctgtatgcttcctgtatcagctcgtcctggttgttgatcttgcccaccgtggtgatggcaaaacttcccaggtgtgactggattaataagggctggggttcgttatcggaaatacatccaatcccaaaatatccctccagctcgtttaaatcgccgtcaaattttgtacggaacgggctgttttctatattatggatggagcgggcaaagccctgttccccatacacggccatgccgccgcgctttgtaccaagatgggagtggtaatcgactccgaaaaaaagatccaatgtacagctgttcttagatacaacaccaaatattccgcccatgtatattccctctttgatagtagtggtctgtcattctgcctgttacaggacttatcataacatatattagcattaaaggacaatatgaatgatatattatttatacttataatgcctcataagcagtgcaggacatccggggaattgcaaaataataggactcattgtataattaatggatatattaacagccaggatttcagaaagatattttatcatagaggagaaaaggggcattcatatggacttatacaggattattctggtggatgacgaggaagaggtcagacagagcatcatcaggaagattaactggacagaagcagggtttcaggttgtgggggacgcggagaacggggaggacgccatggagaaggtggaggcactggagccggacctgatccttacggatatccgtatgccgtacatggacgggctgaccctggcggagaaggtgcgccagaaatatccctccatcaaaatcgtcatattttccggatacgatgactttgaatacgccaagcaggccatcaagctgaatgtgacggagtatatattaaagcccgtgaacgtggaggagctgaccgccatcttaaagcgcatcaaatccaacctggacgaggaaatcgaacagaagcggaatgtaagcctgctgcgggagaactatatcaaaagccttcccatcctgcgcgaacagttcatcaacgagctgatcagttatccagtgccggaagaaaccgtggccgaccgtctgcaggaatatgacataccccttgccggggccaagaagtgggtggctgccgccatcgatatcgagccggaggaaatccggggcagtgccatgctccccctgcacaaggagaaggacctgattcccatctccgtgatgcagatcgtggaggagaagttaaggaattactgccgctgcgccctggccacctcggccaggacggcggcggcggagattgcggtcattgcggccattgacggggagaacagccagaccgggctgattgatgtattgggtgatatctgcaaggagacaaagaaaatcctggaggtccccatcacggtgggaatcggccacgggtgccaggcattgtctgaaatcagcagttcctacaaggctgcggtggacgcccttggatataaggccatcgtgggaagcgggagcaccatctacatcaatgacgtggagccggtcagcggcggtaagctgcagtttgacggcaaggacgaggcggagctgattgcggccatcaagttcggccccagggaaaagatagaggaagccgtgcgcagcgtcatggataagatgagcgatgcaaaggtgcatttccgccagtgccaggcttatatgctgagcgtgtccagcagcatcatacagaggatccagcagcatgacctggatatggcccagatcctggaggagggggaggagcacgaggatacctttgccctgattcccaagatgcagaaaaaagaggatttcagccagtggcttctgtccgtggccctgcggatgaaccaggtgatgaaccaggaacgtgacaacaccatgaagcaggtaatccaggaggccaaggaatatatcatggacaattaccaggatccggacctttccgtggagaaaatctgccgccacctgcatatgagcccggcctatttctccaccatgttcaagaaggagacgggacaggcttacatcgcctacctgaccgaggtccggctcaacaaggcggtggagctgctcaataagaccgatgacaagacctatgtgattgcatccaaggtggggtatcaggaacagaactatttcagctatgtgttcaagaaacgcttcgggatttcccccactaagttcaggggagcgaaaaggtaaggagacggacatgctttttgaaaagcagaggcagggggtgcagaaggccagcatccgctacatcatattcatttattttacgctgaccgccctggctgccagcgtattcatcggaatttccctctatacaaggctgtcgggacagatggcggacaccatacaggaagagaaccagatactgattaaccagattaaccgttccatggattcctacctgcagacagtgatgaagctgtccgattccctttattacggcgtaatcaagaacgcagacctttcagacggttccattggcagcgagattacccttctctatgacaataacaaggataatattgaaaatatcgccctgctgtccaagaccgggcagatgctggaatccgtgcccgcggccaggctcaaatccaatatagacgtaatcgacgagaactggttccagaacacccttttaaagacggagaaccttcatttctccacaccccatgtacagacaatcttcgatggaagcgaaagccagtaccgctgggtcatttccatgtcaagggcagtggaaatcaccaacggtccctatacggaccagggcgtgctgctcattgatatccgctacaacagcctggaacggctgtttgacggcgtgaacctgggcaacggcggatatgcgtacctgattagcagcgatggggaaatcatctaccacccaaaggcccagcttatcgactccggcattgtcagggagaacaacctggaggcggccggccttaaggacggcaattacgaggaggtattcggcggggaaaagcggattgtgtccgtgaagaccgtgggatatacgggatggaagattgtgggcgtgacgcctcttgacggcatgtccctcaacaacatcaagacaaagcttctgatggtgttcatcatcgccttcgtgctgttcatcctctccatcatcaactcctacatttccaccaggatcacggatcccatcaaggagctggagaaggcggtcaatgagattgaggaaggaaacctggaggtggaggtgaaaagcgccggttcctatgagatacagcatctgggcacttccatccagagcatggccagacggatccggaagctgatgaacgatattgtggcggagcatgaatccaagcggagaagtgaatttgacaccctccagtcccagatcaacccccatttcctctacaataccctggatatcattgtgtggatgattgaaaatgaaaagcagtccgaggccgtgaaggtggtgacggcccttgcaagattcttccgcatcagcttaagcaagggaaagagcatcatcccggtaagggacgagctggagcacgtgcgcaattacctgatgatccagcatatgcgctataagaataaattcacctatgccattgaggcggatgaggatgtcctggaactggcaagcttaaagctcatgctccagcccctggtggaaaatgccatctaccacggcatggagttcatggacggggacggggaaatcctggtcagggcatggcgccgggaggatgacctttatatgagcgtgtccgacaatggcttaggcatgacccgggagcaggtggaccgcctgttctcagccgcggaccatatgccctcaggcagggggtcgggtatcggcgtgaagaatgtgaatgagcggatcaagctctattttggaactggttacggccttgaaatccagtcggaaccagatgagggaaccacggtgacggcgcatctgccggccatttcctatcaggaagcaaagaaagaggaagcctatgtcaaataaagggaagattctctggtgcatatgggccggtatcctggtcctgctgtttttgatgtcctccacggaccttatcatcaaggaaaaggaaatcgaggtatacccggtttccgtcatcatcgacggggacaatgatgactactatgttaatttaaaaaagggcatggaacaggcggcggtggagttccacggggacgtcagcttcatcaccctttacgccgaccatgaccaggcacagcagacggagctggtgaaacgggaaatcagggatggggcgcgggctgtcatcctggctccggtgaagccggaggaggcggtcaaggagctggagaccatgaatccgggctgcccggtcctctttcttggccgtccccagtccagcggcagggtggcggataccatcggtgtggacagccaggagattggaaggatgctgggggaggccgctgtatcccaggccccgaaggacgtcccggtctatctcttttgcaaggggttagactatggggacggcgccctggtctatgagggggtcagtggcgtgctggaggaacatgggtatgattaccggctcattgagaagaagaaccaggacacatataggcaggctgtccaggaaacggattcccccggcagcggcaagatcaccatcatagccctggatgtacagtccctggaccaggcagcccagatactggaggaggacaccatataccagggcagggtgtcagggctttacggagtggggagcaccacatccttactcagggcgctggaaaaggggattgtcacggggatgacggcctataaccagtttgacgagggatatttaagcgtgaagcaggcggtggaagccatccagggcacgcaccagaagcaggagacgcggcttacggccatctacgtggataaggacaggctgagggataagacatatgagaaaatgttctatcccattgagtagcggaaatcgggaaaatgaaaggggtatgggccatgaagcggaattggatttatttactggcggtttgtttaggaatcggcatcctcatagggttctggcagtacagggaaaatgaaggacagcggcagacaaagaagaattccatccgcatcggggtccttctctaccgcggggatgataccttcatcggaaccctgcgcgcaggcctggaggataaggcaaaggaatatgaacagaaaacaggaattaaggtgaagctggatatcctggactccaagggaagccagaatacccagaacagccaggtggagcgcctgatttccctgggctgtgacgctttgtgcatcaatagcgtggaccgttcatcggcttccatcatcattgacaaagccatggatgcggggacccctgtggtgttctttaaccgggaaccggtggaggaggacatgaaccgctgggaaaagctgtactatgtgggcgcggatgcaaaggaatcggcggtgctccagggagatgccctggtggatgcatacaggaaggattcccgcaccctggacgccaacgggaacggtctggtgagttatgtgctcctggagggggagaccagccaccaggactccctgatccgcacggagtggtccatccagacattaaaggacggaggggttcccctggagaagattacaggggggattgccaactgggacaggagccaggcttccgccctgatggaacagtggctgaaggaatacccgggacagatagaactggtggtcagcaacaatgatgacatggccctgggcgctatcgacgccatgaaccgggccgggatcggggccaattccatcaaggtggtgggcattgacggcaccccggtgggcataaaggccctggaggagggaaccctcttcgccaccgtggaatcggacaaggaacgttacgcccaggccatattcgacattgcctggagcctgtccctggaccaggaccctaagtccgtggtaccgctggtcaatgggaaatattactggtgtccccagcgggtcctgacccaggaggaggcaaaactgcttaaaaataagtaagctcccataaaaacctgataaaaaaatacagaatcaaagaaattttataatcattctttaaaaatcctatggaaaaatgcacaaccaggccgtataatggccttgttgttaagcaaaaacaaccaaagacaatcataatatttataagggaggaattcaaaatgaaaaaagcattaagtgttgcccttgcgtgttccatggcattatcactcgttgcctgcggcggcggaagcaagccaacggaagcaccaacaacagcagccgctggtggtgataccacaactgaggcagcagctgacacgacgaccgaggcagcagcagctgacagcggcgcagaaatggccaacaaggacaaaccattggtatggtttaaccgccagccatccagcagtgctacaggacagctggatatgacagccctgaatttcaataaggatacatactatgtaggtttcgacgccaaccagggcgctgagcttcagggtaccatggttaaggattacatcgagaagaacattgacacaatcgaccgcaacggcgacggaatcatcggttatgtcctggcaatcggggatatcggacataatgactccattgcacgtacaagaggcgtccgtaaggctcttggaacaggcgttgataaagacggcaacatcaacagcgatccggttggtacaaacgcagatggcacagccactgttgtacaggacggctccattgaagtgggcggcaagacatacgtggtccgcgagctggcttcccaggagatgaagaactccgcaggagctacatgggatgcagctaccgctggtaacggaatcggcacatggtcttcctctttcggcgaccagattgatatcgttgtatccaataacgacggcatgggcatgtccatgtttaacgcatggtccaaggataacaacgttcctacattcggctatgatgcaaacagcgacgcagttgctgccatcgcagaaggctacggcggcacaatcagccagcatgcagacgtacaggcatatctgacacttcgtgtgcttcgtaatgcactggacggagttgacattaacaccggtattgcaacaccagatccagcaggtaatgtcctgagtgacgatgtatatgtatacagggcagatgagcgttcctactacgccctgaacgttgctgttacttctgacaactaccaggatttcatggattccaccatggtttatgcacctgtatccaaccagctggatgccagcacaagccctgaaaaggctgtatggctgaacatctacaactcagctgataacttcctgggttccacctatcagccgctgcttcagaagtatgataagcttctcaacctgaaggttgactacatcggcggtgacggacagactgagtccaacatcacaaaccgtcttggaaatccaagccagtatgacgcatttgccattaacatggttaagacagataacgcagcttcatacacatctctgcttgagcagtaataatcattgaaataaaaatgtactgttgactgttattagggagaagaaattctccctaataatcgatttagacttaatactgaaaccaatcaatctatgtatacaggagtaaaataatggcagataagaaagatgatatcgtcttatcaatacgcggtatgagcaagtccttcggccgtaacagggttctggaccatatcaacctggatgtgaagcgtggaaccgttatggggcttatgggtgagaatggcgccggcaagtcaaccatgatgaagtgccttttcggcacttaccagaaagacgagggaaatatcttcctgaatggcaaggaagtaagcttttctggaccaaaggatgctcttgaaaacggcattgcaatggtccaccaggaactcaaccagtgtctggagcggaatgtgattgataatctgttccttggacgctatccggtcaattccatgggtgtaattgatgaaggcagaatgaaaaaggaagccgctgagctttttaggaaattgggcatgaccgttaaccttacccagcccatgggtcgcatgtccgtatcacagaggcagatgtgtgaaatcgctaaggccatttcctataattccagagtgattgttctggatgagcctacttcctccctgaccgtacaggaggttgataagctcttcgagatgatgaggatgttaaaagagcagggaatcgccctgatttatatttcccacaagatggatgagatttttgaaatctgcgatgagatatcagtgcttcgggatggcaacctggtcatgacaaagagcaccaaggatgcaaacatgaatgagctgattgcggcaatggtgggccgttcccttgataaccggttccctccggttgacaatacccctggggatgtgatcctgtccatacagaatttatccacgaagtttgaacctcatctgcaggatgtctcgtttgacgtaaaagaaggcgagatattcgggctttacggcctggtgggggcagggcggacagaacttttggaaacaatctttggtgtccgcaccagagcggcagggcgggtttatttcaataaccgtcttatgaatttcagcagcgcaaaggaagccatggagcatggctttgccatgattactgaggagcggaaggcaaacggcctgtttttaaagggtgaccttacctttaataccaccattgccaacctgcagcagtacatgtcaggaatggcgctttccgatgcaaagatggtaaaggccacggcaaaggaaataaaaatcatgcataccaagtgtatgggtcctgatgacatgatttccagcctttccggcggcaaccagcagaaggtcatctttggaaaatggctggaacgcagtccgcaggtgtttatgatggacgaacccacaagaggtatcgatgtgggtgcaaagtatgaaatatatgagctgatcatcaatatggcgaaacaggggaagacaatcatcgttgtttcttctgagatgccggagatactgggtatcacaaaccgtattggtgttatgtcaaatggacgtctttcaggaattgtcaatacaaaagagacggatcaggaagaacttttgaggctcagtgcaaaatacctataagggggattcatggatatggcgaaaggaaacaatgagactcttacggctgaacaggagatgcagctgcgtcagccaattgaggattatgttggtgaaattcagaaaaagattgacagcctcaggaccgatggtacgaacagggtagtagccctgcagaacagtatcgatgcggcaaagagggaccgttcccttacaaaagaagaaagagcgaacaggattgctgccaacagcgcggagatggaaaaggcaaaggctgttgaggcaaagaataaagatgaaatcgcaaaattgatttccgatgcggagggttacctcaaggcgcattttgataaggactattatcagcccttaaaggcaagctgcgaacaggaaaaggcgctggcaaaggaaaaatatgacaccagggttgctgagcttaacaaggagcatgaaaagacactgtcaaagcttaccgaccatcaggagattaaggatgagaagtacgtccataagaaccgtctgtttgacgcgaagatggacttagacaaggaacttcagcgcattaaggacagaaggcatgctgcttttgcatggcagtaccacctgattgatatgctccgtctgtccaaattcaccttcatggagaccagggcgcagaaatgggaaaattataaatatacattcaaccgcaggacattcttactgcagaacggtctgtatattgccatcatcctgattttcatcggactgtgtatcgctgctccggtggtgaagaatgtaaaactgcttacctataacaatattttgaatatcctgcagcaggcttccccaaggatgttccttgcgctgggcgtggcagggcttatcctccttactggtacggacctttccatcggacgtatggtcggtatgggtatgaccactgcaaccatcatcatgcaccagggtattaatacaggcgctgtgttcggacacgtgtttgacttcacagggatgcccattggcttaagggttgtatttgcactgtttatgtgtattgtcctctgtacgtgctttacggcaattggaggtttctttacagccaaattcaagatgcatccgttcatatcaaccatggccaacatgctggttatctttggtcttgtcacttatgccacaaagggcgtgtcctttggtgccattgaaccggcaatcccgaagatgatcattccaaaggtaaacggattcccaaccatcatcctttgggcagtggcggcaattgtaatcgtatggttcatctggaataaaaccaccttcggcaagaacttatacgcagtgggcggcaacccggaagcggctgctgtttcaggtatctccgtattcggggtaaccatgggggcattcatcctggcaggtatcctttatggattcggatcatggctggaatgcgcaagaatggtaggttccggctccgctgcttatggccagggctgggagatggatgcaatcgcagcctgcgtggtgggcggcgtgtcctttaccggtggtatcggtaagatttccggcgtggtagtcggtgtgctgatcttcaccgtacttatctactcccttaccatccttggtattgatacaaaccttcagttcgtattcgaaggtatcatcatcatcacggcagtaacgcttgactgtctgaaatatgtccagaagaagtaagatttagtaagatttgtttgatgcggtgccggcagccttgagatgccgggggccgtctgaagaccggctggaaacagaaggctggctgcaaacccgcagccagcctttttctgcgcccaatggctgccaggcccggacaaaggcagccattgggtgaacggttaccggcttaaatcgcaggccagcctgctgttctggtattcgccggaaaacgttacatctttgccgaaccattggggcgggatgaaggtgagcgcttcctcctcagtggggaattctacctcggccagtataaggcctttgtaggttccttcgaatacatccaattctatggtcagatgaccggaaccttccagtgggatcagatagcgcgtcttggtcaggatgatgccgtccgcctttttaagcagatgggtgtaagcctgttcattgaggggaaggttatattcttccctggccatcaggccttttcctttgtaggtgagataatagctgtcatcctccttgcggatgcgcaccacggggctggtgcacaggtaagcctgctcaatggcatggcaggggaattccatgtagtctgcggggacttgattcaccagatatttcctttcaatttccatctttcatacctccaaatactgtatacataatgcaattagtggattttactaaggaatgttattttttccattttactatcatatcatttatcacttttcagaaaaagactaaaatgataaaataaaaatattgtgcgttgttatgttgtattgtgtcagtatggcaggaaagggagaaaatcatggcaaaggtttatgcatttctggcggaagggctggaagaggttgaatgtcttgcggtagtggacgtgcttcgccgttccggagttgaggtgacaatggtttccgtgtccggaaagaaagaggtcacaggatcccatggaatccggttaatggcggatgcgctgtttgaggaggcggatcctgatcaggctgatgtgctgtttttgccgggtgggatgcctggtaccaataacctgagggaacaccgggggcttagggaagccattgaacgtgcgaataagcagggccggagggtggctgccatctgcgcggcacccagtgtccttggagccatggggctgttaaagggcaggacagccacctgttatcctggatttgaggagcagcttaccggggtatcctacacaagccagggcgttgtcactgacggcaatatcaccactggcaggggcctgggatatgcgctggatcttggccttgaactgatacgtcttcttcagggaccccagcaggcccagaagattgcggcagccatccagtacagccgcggttgactgcaggagtgatggaacctgcaggaataatgaaactgcaggagtgatggaatccgcaggaataatggaattcccccgcttgtgccgcatcgatggaagatgcggcacaagcgggggagtttttttgatgtgatgcaaagtatatcgttttaaacgtaaggcatgacggattgcgcatgggaacctcaggacctgtctggcggctgcgtcctgtttcctgtgcatccttccttgcgcacccgctttttctctgcatggcctacaatggtagtgcctgccaggtcatccagacagttaatcatggtcattccccatgtcgttgaaggcgtggacaccggctgccaggcccacaatctccagcgggaatccaagtgactccgggaggatagccaggatgacgtgctcatgatccgcagtggtcttattcgcgcagcttacggctatttgaaaatccgcgccatgagcagggtgtcgtaataccgcccatcgcttagcagcttgtcatcgcgcaaaatgccctcctgtacaaacccctgactttcatacagcttgatggcagaagtatttgtcgccatcacccgcagggttagcttgtgcaagcgggaccccgtctcggcccaggtaatgcaccgccgcagcatctcccctccgattccctgcccccagtattctttcaagacgcatacaccaaactcggcctgatgtcgcaggcggaccaggcgggagccggcacagcggcaataggccaccagccgtccgccatcctccgccaccaaaaacaggtggttattttccgccttatccccggcgattatagcgcgccaggcggcttcatccaggtgggcttcccccggttcgcggtccatgttttctgtctctgcatccaatataggccgcagcgcggccagttgtgcggcgtcgtcttcgatcgcctgtcgaatggtatacaagtgcttttcctccttactatatagagtggagtataaagtatagcacggcgccaagggaatgaaaagcccgaatcagtctcttatatgacgagtaaccctgccgtatatgtcattgtaaaccgcgtagccaatccgtttgatgaagcatggggcatgggcgttcccgcgtggctgcgccgcgcctgtaatggtggtctgcatcgtcttggctcccttcaatattaataggcatggactatccgaccgaaaactgtgtttctgactggggctggatatacagggaaatatgtacaggaaatttatgaaaaaatgctggtattttcattttgagcatgctataatggtacattgaagtgtagcgccctcatggttcatgggcgaatcacatatattttaaggaggaacccgtaaaaatgagtgtacaagtagaaaaattagaaaaaaacatggccaaactgacaatagaagtagatgcagcgcagtttgaggatgcaatgaagaaagcctttaataagaataagaataaattcaatattccaggcttccgtaagggcaaagcaccgcgtgccatgattgaaaagatgtatggcgaaggcattttttatgaggatgctgctgatgaagccatcaatgcaacctgcatgcaggccatggacgagagcggactggagatcgtgtccagaccggaagttgccgtggagcagataggcaaggacaagccattcatttataccgcacttgtagctgtaaggccagaggtaaccctgggcgaatacaagggcattgaagttgagaaggcagacgcggctgtgacagctgaggatgtggaagcagaacttaagaaggtacaggagcagaatgcaaggcttctgagcgttgaggacagaccggttgctgacggtgacaagactgtcattgactttgaaggatttgttgacggcaagccatttgacggcggcaaggcaacggattatgagctgaccatcggcagccactctttcatcgatacattcgaggagcagctggttggtaagaatatcggcgaagagtgcgaagtaaacgtaaccttccccgaagagtaccatgcgcctgaactggctgggaagccggctaccttcaaggtaaccgtaaaggaaatcaaagtaaaggaactgcctgccctggatgatgaattcgcaggggaagtttccgaatttgagaccatggatgaatacaagaaggatattgaggcaaagattcttgagaggaagcagaaagaagctgccactgagaatgagaacagggtggttgaccgggttgctgccaacgcaagcctggagattcctgataagatggtggaaagccagattgacaacatggtccaggatactgcccgccgtatgcagggacagggcctgtccatggatatgtatatgaagtatacaggcatgaccatggataccatgagggaccagatgaggccgcaggcacttaagaggattcagaccagactggtgctggaggaagtggttaaggctgaggacattcaggtttctgacgagaggctggatgaggagcttgccaagatggctgcagcttaccagatggaagtcgataagttaaaagaatacatgtcagaccgcgacaaagagcagatgaaggaagaccttgctgttcaggaagcagtcgatttcctggttgctgaggcaaaactggtataattcacactggaaagtccacgatggaaagaatcgtggaaagttatgatacggggggtttacagtgtgggggccatactgtgaatctcctgggtttttgtaagtgagtatataatatgactgtgtgacaggaggatgatcatatgagtttagtaccctatgtcattgaacagaccagccgtggggagcgttcctacgacatctattcaagattattaaaagagaggatcatattcctgggagaggaagtaaatgatgtatccgcaagccttgtggttgcacagctcctgttcctggaatcggaagacccgggcaaggatatccatctgtatatcaacagcccaggcggttctgtttctgcaggctttgcaatctatgataccatgaactacatcaagtgtgatgtgtccaccatatgtatcggcatggcagccagcatgggtgcattccttcttgcaggcggtgcaaagggtaagcgtttcgcgcttcctaattccgaaatcatgatccaccagccatcaggcggtgcaaagggccaggccactgagattaagattgtggccgagaacattttaaagaccaggaaaaagttaaatgatatcctggctgccaacaccggaaggcccatagaagtgattgaacgcgacacggagcgcgacaattacatgtctgccgaagaggcaaaggaatacggtcttattgatgaaatcatcgctcatcattaattggaaggccggacagaagtaaggatgattcccggttggataaattgggtaaaagcatgaaaggttaggtaacgtatgccaattagaccagatgacacgatccgctgttccttctgcggaaggactcaggatcaggtacggaagatgattgccggagcaggcaacaacaatgtgtatatctgcgacgagtgtattgagctgtgctcagaaatcctggaggaagagctggaggggcaggaagattcagcatccccggccctggcagatatccgccttctgaagccgaaggaaatcaagacattcctggatgaatatgtcattgggcaggatgaggcaaagaaagtgctgtccgtggctgtttacaaccattataaacgtgtcacatcctgccagaacatggatgtggatgtacagaagagtaatatcctcatggttggtcctactggttccggtaagacttacctggcccagaccctggcaaagattttgaatgttccatttgccattgcggatgccacggctcttacagaggcagggtatgtgggcgaggatgtggagaatatactgttaaagctgatccagtcggctgattatgacatttcccgtgctgagtacggtatcatatacattgatgagattgataagattaccaagaagtctgaaaatgtttccatcaccagggatgtatcaggtgaaggcgtccagcaggccctcttaaagatactggagggaacggttgccagtgttcctccccagggaggcaggaagcacccgcatcaggaactgcttcagattgacaccaccaacatcctgttcatctgcggaggcgcttttgacgggctggagaagattgtggaacagcgcatcagcgccggctccattggatttaacgcagaggtggttaataagaatgataatgacattgatgacctgttaaggaaggtggaaccaaaggatcttaccaagttcgggctgattcctgagttcattggccgtgtgccggtgatggtgtccctccagtccctgaccaaggacgccatggtacgcatcctgtccgagccgaagaacgccctgacaaggcagtatcagaagctgttcgaattggacaatgtaaagctggagttcaccagggaagccctggatgagattgcacagctggccgtggaccgtaaaatcggcgccaggggactgcgctccatccttgagacggttatgatggatctgatgtatgagattccatcagatgatacaatcggaatctgcaccattaccaaaggggtagtggataagacaggacagccggaactggtataccgcgatatgcctcctgcgtctgcccgtaagccgctgtccgacaggatgcggggagagggaaagacaggcgagattgcgtaggaggatgattcctgattaatgaaaccgggaaagatgcggttcgtttctgtgacaatttagacaaagggaaagggccgctgcaaaccagatatgacccggatgaaagccgtcaaggctctgtccggcacctgtattgcagcggccctttggatgtttgacatacaagaggtgaagtttaagaatggcagaacaagtgataataatgcccgtagtggcactgagaggactaaccatacttccgggaatggtgctgcattttgatgtgaacaggcccaagtccgtagccgctgtggaaaaggccatggtaggggaccagaggcttttccttgtggcccagagacatcctgagattgtggaccctgaacttggagaactgtaccaggtgggcacggtagctgttgtgaaacagctggtcaagcttcctggcaaggttgtcagggtgctggtggaaggccttgagaggggtgaactgctgtgtctggactcagaggaaccggcccttataggggaaatcggctccattgagacggacggggaagagctggattatctgacccaggaagcaatgctgcgcattgtgaaggacaagctggaagaatatggaagggtaaacccgaagattacgaaggaaatccttccaaacctgctgtctgtcagcggattggatgagatgctggaccagattgcaatccagcttccctgggattacacaatccggcagaccgtattggagaacagttccctgtcagccaggtatgaagtagtgatgcatacccttatgacagagatggaaatatacaggatcaagaaggagttccaggagaaggtaaagtctgatattgaccagaaccagaaggaatatatcctcagggagcagatgaaggtaatccgtcaggagctgggggaggacaaccccctgtcagatgcggatgaataccagaagaaactggacagcatgaaggctgacaaggaagtaaaggaaaaactccacaaggagatagagcggttccgtacaatgcctgccggaagccaggaaggcaatgtgctccgcacgtatattgagacgctgctggaacttccctggaaaaaggtgtcaaaggataatgacgatatccggcatgcggaaaaaatcctcaatgaagaccactatggtctggagcaggtgaaggaaaggatactggaatatctggccgtgcgcacactgacgaagaaggggaccagccccatcatctgtctggttggcccgcccggaacaggaaagacatccattgcccgctcggtggcaagggccctgggcaagaagtatgtccgcatcagcctgggcggggtcagggatgaggcggagatccgcggccacaggaagacatacgtgggggccatgccgggccggatcgtggagggcatgagacaggccgggtacagcaatcccctgatgctgctggatgagattgacaaggtcagcagcgattacaagggagatacctcctccgccctgctggaggtgctggacggggaacagaacgtaaagttcagggaccattatgtggaggtgcccatcgacctttcccaggtcctgttcatcgcaaccgccaataccacccagaccataccgggaccgttattagaccgcatggaactgattgaggtcaacagctatacggaaaatgaaaaattccatattgccagggattatctggtggccaaacagatgggacgcaacgggttaaaggacagccagatcacattttccgataaaagcctggaaaaaatcatacacaactatacccgggaggcaggcgtccgcaacctggagcgccgcattggggatgtgtgcaggaaggctgcaaggcagttcctggaaaataataagaaatccatcaagataactgagtccaacctggagaaatacctgggcaaggaaaaggtcacgtttgaggatgccaatgaggaggaccaggtgggaatcgtacgcggcctggcctggaccagcgtgggcggggatacgcttcagattgaggtcaatgtgatgcctggaaaagggaatctccttatgacagggcaattgggcgatgtgatgaaggaatcagcccagacagccctgacctatgtgcgctccgtgtgtccggatcatgggattgcggatgattattttgagaagcatgacctgcatatccatattccggaaggcgcagtgccaaaggatggtccttcggccggcatcaccatggctaccgccatgctctcggctgttactgaaaagccggtgcttgccaaggttgcaatgacaggggaaatcacgctgcggggaagggtgcttcccatcggcggcctgaaggagaaaatcctggcagcaaagatggcccatataaccaaggtgctggtgcctgacaagaaccggccggatatgggagagttgtccaaggagataaccaagggactggaaatcgtgtatgtgaagtccatggttgatgtggcaagggaagcattcgtaccagctgttacagagtagggaaataaggagatatttatgattataagagatgtgaatctggagaccgtttgcggcgttaccagcaagatgccggaaaatatcctgccggaatttgccttttcaggcaagtccaacgtggggaaatcctccctgattaatgcgctgatgaacaggaagtcatatgccaggacctcttcccagccaggtaagacccagaccattaatttttataatattaatggcgcgctttattacgtggaccttccggggtacggctatgcaaaggtggccctggaggcaaaagaaaaatgggggaagatgattgagcgttacctgaggaattccgccatgcttaagatggtgttcctgctcattgacatccgccatgaaccttcggccaatgacaggatgatgtacgagtggatcatatataatggataccatcccgttgtcatcgccaccaagctggataagattaaccgcagccaggtacagaagcatgtgaagatgatccgcgagggcctgggcatggaaaaggatggaatcatcatcccgttttctgccgagacaaaacaggggcgggatgagatatgggatctgattgaaggtaatatgtaggatgggtgcctggggatgtgaaacagcggtgaaggatgcgcccgcagcacaccccggaccggagccggggagggttccccggattggcggcggcaaggaggccaggctataaaagagcagcctctaaagccatgataacagaaaagacggggcggtcatcactgattggatgtgaccccgtctttttagtaccttgttcctatgccatcctgcagggggacttcttataagttgccagacttacaatcactaataacaggccgcatacaacagcgcctggaacggtttctccaaggccgaagggattgcccgcaagcttccatcccacacataccgcaaagccgcctatcatggcggacaggatgccctggttggtggcttttttccagtataaggctgcaagggccgggaggccggctgcggctgcatagaaggaccaggcaaacatgagcacattgtaggcattttttatgtacagggcaatgatgagggcgcccatggccaggaccacggacatgatgcgggacatgaggatttcatgtttttctgtcatttcaggcatgaagttcttgcccaggtcatggacaaaggtctggacggatacaagcaggtagctgtctgccgtggacatcatgacggacaggattccggccagggccaggcctgtaagcccgggtggaaggatgctgattgcaagcgcgggcaccactgcatcggaactgccgtattgtgccaccacgttgggcaggatctgctgtgcaaccaggcccatgaagaataccagggcaatggtcaccatgtagatggaagtgccccagaacatgccctgggttgctgactttttgtttttggctgcaaatgcccgctgccacatctcggcgccggccagggtgaataccaggtaggtgacgatatcgcccaggatactgccgttgatgtggggaaccagataggatttgtccaggttctgccagaacacggagaaattgcccaggtaacggacactggatacggggataaggatgtatacaaagatgatcagcatgaaaaactgaagtacatccgtgtacaccacgccgaataatccagaggccgccgtatagatgatgaagatgacggtggccaccagtgcgccggcctcatagctgatcccgaattcactgcccagcatcttgatgatggttgcggtggcggttacctgtgcagccacggtgcccatcatggtgaagacaatcatgagggccaggacacagcgggcgttcctgctgaaacggtagtggaagagttcgggaatggaattgatgttgcgggccgcgcccacctcctggatccttcctgcgatggcggagaagatgaacatgccgatgagataggggattgctgtcatgatggccttgaagccggtggtgtatgcgatgcctgcccggcccatcatggcgcttccgccgatgatggacgcgcacacggtggctgtcagcacgaagggacccagggtccttcctgccacgtagaaatcgcctgtattcctaatccgtttcacaaaccatactcctaccagcagcataccaatcatataaaggacgatgatagtcagatccaatacggttagttcatgcataaaacaggtctcctttctgaatggcgccgcttgtgggagaaggattcaatttttaagttggtaaggaaaaaagaatggactttaattaagaaatccgcctgcaatgaatgcaggcggaaaagtatgcggcaatatagcaatgctggacatatggaatcatatataatccatatgaaactacaatataccagaatgtccgtgtccctcttccgcctatgagattagctgccgggttagggaaaagaaggttccctgatgtcaggatatcccaaggacatgcctggacaaatacaccccaaaaaattggttctcccactgttgctgtgagcaacattaagcgactttgttatgtgttaacgctatcttaacattaaatataccatagatgggggatggtgtaaagaagattcaactcgacatatcctgcatttagcgtataatatatactggaatacggtatggaaacaaaagaaactgattattatctggaggtatgagtaatggaagggggacctatacgggcagcggtcatggcagatacccatggcgtgctgcggcctgaggttgagaggattcttgaaacctgcgacgtgattatccatgctggcgattttgacagccagatgctgtatcataaattggatgtggaccagcccttgtatgcggtcagggggaataatgacaggggatggtccggggggcttgccacggttaagcggtttgagattggcggggttaaattcatcatggcccatgaaagggtggatatccccagttcgctgaaggatgtccaggtggtcatattcggacattcacacatgtattaccagcaggaaatcaatggaaggctttggctgaatccgggaagctgcggttataaacggtttaccctgcccctgtccctggctgtgatgaccattgaggacggtaactatgaggtggagaccatatggctggaaaaaggctatggaacccctggagcggccaaggcacagatggaaacgtccaagatgggcaagtatgaaaagcagcagcggcgctataagcagaaggctggaaaagcggcgggcggaaagcaggcagcggataaggaacagcgtgattcccggaggaaagaggcggaacgggacagcctgttcatgatagctaaaatccagcggctgaaaaaggcaggggaaacaagggactgggtcatccggaatctgggagatgagtataagcttgccgggaccgtgtatgatatctgcgaaaaaaagccaggcctcaatgcccggcagatattggaactgataaaggaacagatcatgtctgtatgaaacaacaaggatggaaccggggcaattgccagccgtaccgacaggctccggggccagcttcaggacaggagggtgcgcatcacatgcgcatatatctcctggctttttgttttccaggcattgcacatggattcggcctgctccttatctggtacggataaatccaggcggatcaaggtggtcttgttttcacggacctcgcagtggacgatatagtcctgattggtcccgcggtaaaagtcagcggtggtgcctacctcttcccggaggcggaacttgttctccttaagatactggtccatgtcctcaatgatggccgaggatatgttcttcccaaagaagttcagggtttcctcgccttccttggtgatatcatagcgggtactgttatggctggcctccttgtggaccagaccagcgtcttccagttcatttaaagcctgctggagggtgaaatatgtggtgtactcatgctctgtaaagaagttggtcaactgggcattggtgagggggaagttcacctgctttaacatatagagattcatcagtttatacaaggtcataggttcagtcagcatatcatacactctccatcaggttattacatattgtcagatataatcctttacagccctgcttaccacatcagccaccctggggtcaaaggcttccggaagtatattatcttcgttcaggtccttttcatccacaagccctgcgatggcattggcggcagccagcttcatctcttccgtaatggcggtggcacgtccttccagggcgcccttaaagattccgggaaatacaaccacgttgttgacctggttggggaaatcggaacgtccggtcccgaccacctttgcaccggctgcttttgccaggtccggcatgatttcgggaaccgggttggccatggcaaatatgattgcgtcctgattcatggatgcaaccatatcctttgtcacgataccgggggcggaaaccccaatgaagatatcggcgcccttcatggcatccgacagggaaccggtcctgtgttccaggttggttaagtccatcattttttcctgcatccagttaaggccttctgcgcctttacagaggattcctgatttatcacacatgatgatatgggggaacccataggtgaggagaagccttgtgatggccacgcctgcggaacccgcgccgttgacaaccacctggcagtcctctttcctgcggccggttacctttaaggcgttgatgacgccggccaggacaacgatggcggttccgtgctggtcatcatggaataccggtatgttaaggcgtttctttaatgcttcttctatctcaaaacagcggggggcggcaatgtcttccagattaatgcctccaaaagcaggtgcgatgcggaccactgtctcgatgatttcctgtgtgtcctgtgtgtccaggcagatggggaacgcgttgaccccgccgaattccttaaacagcacggccttgccttccatgaccggcatggcggccagaggcccgatattgcccagtcccaggaccgcgcttccgtcggatacaacggcaatggtgttggacttgatggtataaaggtaagcggcctcagggtcctttgcgattaccttacacggttcagccacgccgggcgtgtaggccagggccaggtcctccctggatgccacggttgcttttgatactgtttcaagtttccctttccattcttcgtggagcatcaatgctttttcattggttgtcatgatggattccgtccttttcctatgatatatagaattaaaaatgcattttcctatatcataacaattttaacaatcataatcaagttccttttcagattatgtttttcatgagctttaaagaattattcaattaaaacttttaaatcaaaataaaatgtggtatcatgttacataagtgtgaacaatatacacataaggataaagatacaggtggtactatgagggaacggattaaccgtctggccaggggaattattgacagcgggattccggaactggtgctggctccggataaggtagaggcagtggttccggcgggtgaggtcatccgtggtgagattgtggtgagcagcggaaacaatctgcatatcaaagggctggtgtattccagccatgcaagggtgcaggttgtggacaacgcctttggcggcctgcgcaaccgaataatatacgaagtcaacagccggtatactgagcatggggacgtcattaagggatctttttatcttgtcaccaatggaggtgagagggagattccttattctttgcgcgttcaggccggaaacgggggggaagtattcggctcccttgccacgccaagggattttgcggccctggcaaagagggatttggagacagccctgagggtgtttgaatatcaggattttacagaagcgcccttcatgcaggatgcgcgcgtccgtaccatctatgaaggattaaagggcagggcgggcagacggaacctgcttgaggaattcctggtggcgctccatgtaaaggagcctgtcaggctgtccatggacacagggaaaaggacatacgggaatccgcaggaaccggtgggggattccattgacattgcagccggcagctgggggtatgtgtctgcggatattgaaacagacgccccctttattgaactggtgaagacaaagataacggatcaggatttcatcaacagcaggtgccgcatccactacaggattgtgcctgcgcggcttcacaggggacggaatttcggacggatcagggtacggtccctgagggaagaattcatattggagattgaggccatgggggatgacgcgtcggacatcaccggacgcggccccaagaaggatggcaggatggacagggaaagcctgctgcgttatctgtccctcaggctgaattacgagacagggatatatgagccggcccttctgctgaaccagatgacaaaggaagcagagcgcctgcgggcggattacccggatgacatgcgcaccaggctccttcaggcggagcttatgatccttaacggcaaacaggataatgcattcatggtcctggaggaaacaagggacagcgtgctgaggaacagggagaagcaggtggagatatactgcttttaccagtatctgcgcctgcaggtaaagccttccacggatcagaaggaatccctgatccgctatatcaggaagcttctgtgggaggacggcatggtccgcccttatctgttcctgctccttgtaaggctggatgggaccatggcgcagaatccgctgaagctttatgagacaatggcatccttgtttgaaaacggaagcaacagcccattcttatacacggcggcctgcaggcttatggaggaacatcctgacctgctggtccgtctgggcgattttgagatacaggtcctgtatctgggcatacagaagaatatggtgagttcacggctggcgcttaaggcggccgggctggccctgggaatcaagcattacagaaagctgctggaacgtctggtggtgaagctttatgaggcgtatccggatgtgggcctgctggaggcattgtgcagcatcctcattaagggggagcgcaagaacagggacgcatttgagtggtatgagaaggcgctggagcagggggttaacctgaccaggctgtatgagtatttcctgtattccctgcccggggattacagccatctgctgccgagggaggtgctgctgtatttttcctatgacaaggacctggacaatcacagccgttccgtgctctaccggaacatactgctttatatgaatccgtcatccgagctgtatcaggcatacacccggcatatggaacagtttgccatggaacagctgttccgttccaagattaacagccgcatggccgtgatttacgagcacatgatatacaaggacatgattgacatgcgggttgcccgggtattgccgggtatcttaaggtcctgccgggtccgctgtgaggatcccaggatgaagtatgtgattgtccgttacgaggaactggaagaggaggaggcatacctgctggaggaccaggcagcctatgtcccgattttctctgaccgcaatgtgttgctgttccaggatgcctatggcaaccggtatctggacgtgaaacactggaaggtgccggtgatggacaggcaggagcttctggaccagtgttaccaggtatatcctgaccatcccatgctgcgcctgcgtgagtgcagggccatactggaacagggcgtggggacggacagccaggtggagcttctggaagagaccatggtggaaatgcacctgtcccctgtgtttgaagcctctgtcctgcaggcagtgaccggatattactgtaaaaaggcctcagaagaaaaagccgggacaggaggatttaactgctcctatctgatccagctggataaaaagcgtcttggggtaaagcagagacagcagatctgcgagaccctgatcagccagaattatatgcgggaagcatatgacatgataagggagtacggaagccagtacatcaatccgcacagactgatgaagctttgcgcccggaccatactgatgcggctgtttgaccaggatgacctgctgcttaatatggcgtacagggtgttccaggccggagcctatgacagtgtcatcatggattatctctgcgaacattttaacgggaccggatcccagatgtatgaggttctgattcagggggtgcgggagcatgtggagacatatgacctggaagaacgcctgctgtgccagatgctgtttacgggctgctgtgagcagatggactctgtgttcgagctttatatgaagcggaagcctaccagggaaatcattgtaaaggcatactttacccagaagtgcgtacagtatttcctggaaaaccaggagatggacgagagggtattcgaatatctgaaacaggcagtggcggggagccttgaaaaggacaggatgcccaccatttacctgctggccctgaccaggtactgttccacccttgataaacttgacgcggaagatgtggaactgctcaagggcgtgactgcagtgcttctggaggaaggtctggtattcccctacacaagggagctgtccaggcatatcccggtgccggaggatatcatggacaaggccatggtggagtacaggggcagcagggacgggcatccggagcttcaggtcaggatacttcctgaggaggaagactggcatagtgaggatttccgcagggtctatcagggaatctatgtaaaacagaaggtactctttgagggtgaaaccatggagtacaggatatatgaccataaggcagccgggctttgcaatccatcagggaaaggcccggaggtaagccgcgtgctggcggcagaaggccgggtggagtgcgaccacaagctggagggcaaggaaaacagccgttttgcctgcttgaatgagatggggaccgcactgaaccataaagacagcgaggcactgttgaaggcaatggaagattacctgaaaaagtccgctgcccttggccgcctgttccccattgaatagggctgcctgtgaaattgttgaggtaagtccccggatagatgagccggggaaacgtatggaagttcccaggaaaaatgaactgggaaagtatggaagttccccggatagatgggctggggaacgtatggaggagctgtctatggacggacttgtgatcggtctggatctgaatgatgattatacccagatctgttgttatgataaagaaaagtcctggaccattcctacggtcatctgccgcaggaaggaagaggaaacctggctttcaggggaggaggcatatgcggctacccttctgggggaagggataatagtagataagcttctgaaactggctgcaaaggacgggacgtccacaatcggaggcatatgttacagcggcagcacgcttttaaagctgttcatccagaaaatgctggagtatccgaaaaaggaatttggaaaggacacaatccagcagctggtcattacgcttcagagcgtggatgccaggctgctggatacattgatgtactgtgctgatttcctggaaatcccaagggagcgcgtccatgtcatcagccacacggaaagtttcatctattatgtgctgagccagaaaaaggaactgtggaccaaccaggtgggactgtttgaactgtcctctgagcgcctgtgctattatgagatgaaggtcataaggggcatgaggcggaacatggtccaggcagaagcccagaaccaggaggaggcatttaacctggatatcctggattcgccttccggaagcaagctggcggacaagattctctgctcctgcggggagaagctgcttggcaggaagctgttttccaccgtgttccttacgggaaagggatttgaacgccagaactgggcaggcggtttcatgcggtttgcatgcaaccggagaaaggtttttgtagaagaatatctatttgccaggggagctgcctataaaggggcggattatacccatgatgccacgtcctacccttatatttttgtatgtgaggggcggctccgggctgaggtggccctgcgcgtcatgagacggggcagggagagcagcctggtggtggcgtcctatggcgacaactggtatgaatcaaaaagttcactggacctgattgtggatgggcagaacgagattgaatttaccatcacacccctggattccaagaaacgcaagctggtgcgcgtacccttaagcggtttcccggaacgtcccccaagaaccacccgggtggggctgaaagtgggatttaccaacgaggagaccatgatgatggtaattgaggacaagggattcggggaactgtttcctgcctcaggcgcagtggtgagacaagaggtaagcttatgagtttgatactatgcaggcatgagccggtgaaacatccttattatatcgatgtgctgggaatccacatccattcttcccaggaactgtgctatgtgatttacaaccatcccatcctggtgatggatgatttcatagatgagctgctgattgagttcatacgcagggacctggatatggactatctggcaggccgtatggaaaagcttctggaaacaggcagccggcatgaggacgtattgttcctgttcctgtccgagtgtgactattacaatgataaggaaatacagaaatataagaccacggtggcggccctgcgcgccctccaccccgctgaatatgaaaaggagcgcgcggactatatgttccgggcgcgccaatatggtaaagcggcgcagagatacggcagggtgcttgaatatcccgccgataaacaggtcaatgatgcgttccttgcaaaggtatacaataatctgggcgcgtcctacgccatgatgttccagttcaggaaggcccttggggcctacgataaggcgtacgggctgggtaaggacatggatgtgctgaagcggatttatttccttacggtctttgcgccggaactggatgtgaaggaccgctaccaggccctgttcacagaggaactgaaaagcaagtggaagattgagattgacggggccagcttggatgctggccaggatgaggatgtgcgctccctgagggccttgtttaaaaaagaccccatcaaacgcatgaacggcgcctctgccatggtgcagcggtggaaacaggaatacaggatgatggtatgatgaaacggaggtaactgacatggcttttgacattgcaaaggaacatcttgagaaactgggattgggtgacaggatccatacctttgaggtatccagcgcaaccgtggaactggctgcccaggcagtcggctgtgaaccggcccgcattgccaagacactgtctttcatggttcagggcagcccgatactggtagtggctgcaggagatgccaaggtggacaatcataagtataaggaccagtttggggttaaggccaagatgctctccccggacgaggtggcaggtctggtgggccatggcgtgggcggcgtgtgtccctttgggataaaggacggggtgaaggtttatctggatgagtccctgaagcgtttccacgaggtattcccggcctgcggcagcgccagcagcgcggtgcgcctgaccatcccggaactggagctggcttcgggaagcccggtatgggtggatgtgtgcaaggcatggcaggaggaaggaaaacaggggacggaaccgtccggcatggcaggcatgacaaaaaccgcttgacaaacaggataataatctttatcataaataattatataaaattaataaaaggtgatgaggaagaggagtacactgcttcagaccagcagagatggctgctccgggtgtgggatggatatccagacacaatccgggctggaaggcggccttggcagaggagggtggaaggtagcttctgaacctggatggtgaagggacagggaagatgcctgttctgcgtagccgtcacacgggcggctccgttactggccagagagattgccgggcattggtctgttccggcagaagtaaaggtggtaccgcggaatatccgccctttgcccggccggacggccatatgggcaaggggcctttttatttttcaggacaaaacgtctactataaaagaagtgtggaaaggtaaaggagaaaaaagttatgaaggaactggagaaaacctataatccggcggacatagaggaccgtctgtacgagaagtggctgaaggggaagtatttccacgctgaggtgaaccgcagtaaaaagccgttcacaatcgtgatgcccccgcctaatatcacaggacagctccatatgggacacgccctggacaacaccatgcaggacatcctgatccgctataagaggatgcagggatatgaggccctgtggcagccaggtacggaccatgcggccattgccaccgaggtcaaggtaattgacaagctgaaaaaggaaggcattgacaaggctgaccttggacgcgacggctttcttaaggagtgctggaagtggagggatgagtacggtaccaggatcgtgaagcagcttcacaagctgggatcctccgctgactgggacagggagcgcttcaccatggacgagggctgctctgacgccgtactggaagtatttgtaaaactctatgaaaaaggctatatttataaaggctccaggattattaactggtgtcctgtgtgccagacctccatttcggatgcggaagttgagcatgtggagcaggacggattcttctggcatattaattatccggtggcgggcgagccgggccggtttgtggagattgccacgaccaggcctgaaaccatgctgggcgataccgcggtagccgtgaatccggaggatgagcgctatcaggacatcgtgggcaagatgcttgagcttccccttacggaccgccagattccggtgattgcggacgcgtatgtggataaggaattcggcaccggctgcgtgaagatcacaccggcccatgaccccaatgacttcgaggttggaaagcgccatgacctggaggagattgttatcttaaatgatgacgccacggtcagcgcagagggaccgtataaaggcatggaccgttatgaagccaggaaggccattgtggccgaccttgagaagcagggactgctggtgaaggtggttccacattcccacaatgtgggcacccatgaccgctgcaagaccacggttgaacccatggtaaaacagcagtggttcgtgcggatggaggagatggcaaagcctgccattgaagccctgaagaacggcaccctgcgttttgtgcctgagagctttggcaagacatacctgcactggctggagggaatccgtgactggtgcatctcgcgccagctgtggtggggccacaggattcctgcctattactgccaggactgtggtaagatcgtggtttccagggaagaaccccacacctgcccccagtgcggcggcgccagctttaagcaggatgaagataccctggacacatggttctcctcagccctttggccgttctcaaccctgggctggccggaacacaccgaggatttggattatttctatccaacggatgtgttggtgaccggatatgatatcatctttttctgggtcatccgcatggtattctcaggcattgagcagaccggaaaaacacccttccatacagtgctgatccacggactggtaagggactcccagggccgcaagatgagtaagtccctgggcaacggaatcgaccccctggaggtcattgacaagtacggggcagatgccctccgcatgactctgattacgggcaatgcgcctggcaatgatatgcgtttttactgggaacgtgtggagaacagccgtaattttgccaacaaggtatggaacgcttcccgtttcatcatgatgaatatcgggaaggcgccggatgtaacaacggtttccctggacagccttaccatggccgaccgctggatcctgtccaaggtgaacaccctgacaaaggatgtaacggaaaacctggacaaatatgagctgggaatcgcccttcagaaggtttatgactttatttgggaagaattttgcgattggtatattgaaatggtgaagccaaggctgtacaatgaagatgataccaccaaggcggccgccatctggaccttaaggaccgtcctgatccaggcgttaaagcttctccacccgttcatgcctttcctgaccgaggagatattctgcaaccttcaggaggaagaggagacaatcatggtttcccagtggccccggtacagggatgagtgggattacagcgtggaggagacatccaccgagaccatcaaggaagcggtacgggccatccgcggcgtgcgcacgtccatgaatgtcccgcccagcaagaaggccactgtatatgtcgtatcagaggaccagggcctgttaggtatatttgaacacagcatcagcttctttgccacgctgggatacgcgggggaggtcgtgcttcagaaggataagacagggattgcaggggacgcggtttcagcggtcatcccgggcgctgtcatctatatgccatttgcggacctggtggatattgaaaaggaaatagagagacttcagggtgaagagaagcgtctggcaggggaactggcccggtccaacggcatgctgaacaatgagaagtttgtcagccgtgcgcctgaagccaagattgcagaggagaaagccaagcttcagaagtatacccagatgatggaacaggtcaagacacgtctggcacagcttcagaagtaagcagttccgggagttcagggcgtctttggaacgccctgccgggatgggaagtaattcaggatagagagggagagcaaagcatgattgatacatcaggaagcaagccggtcatccaggtgaagatgtttggcggatttaccattacaatggatgataagtccatgagcgacagcgataaccgttccaggaaagcatggaacctgctcagttatctgatcatcaaccggcgtaaggacgtcagcatcaatgagctgtttaatgccatatggcaggaagggatgcaggacaacccttacggggcgctgaagacccttgttttccgtgtcaggaagatgatggaggcagcaggctttccctcccaggacctgatactcaaccagaagggggcctatatgtggaacccttcctgggagctgtccattgacacggaccgtttcgagttcctttgcagacgcatactggcatcccaggatgacataaaggatatggaaaatgaatggcaggaagcctttgatctgtatcagggcatgttcctcccaaagtcagcggatgacagctgggtggtgccgctgaacacatattatcattccctgtaccagaaactggtgaaggctgcctgcgaataccttctggaaagggaggaatatgcacaggtggaggatatctgttccagggcggcagggattgaccggtttgcagaggatttctattactatatgatttatgctgtttataagcaggggaaccagaaaaaggcactggaacaatataagtccaccacggaactgttttaccgggaacgtctgataacgccttcggaccgtttcaaggaattatatgaaaccatcagtgaccgccagcaggaaatcatcacggacttggatgtcatccaggcatcccttggctgcccgggaaccattgaggaggaaagggagcatggggcttaccagtgcgagtatgctgtatttaagcgccttgtgcagctggaacgccgcggtgtggagcgcagcggcgactccgtatacctgtgcctgcttacggtgggggacaggagaggccgcaccctgaaacctgagatccaggccagggccatggaacggttaaagagcgtgatcaacctttccctccgctccagtgatgcattttcccgttacagtgtaagccagtacataatccttctcccatcagctacctacgagaatggggagcaggtcatgcgccgtatcatgtcggcgttcaacaaggcatatgtgcgcaaggatgttgcggtcacctacagcctgaatgtagtacttccaaaggaagacaccatagaagcatgaatattacagcgaggataatactaccatgaagataaagaatgcagttctgctgcttttgacagccgccatctggggcgttgcttttgtggcccaaagcgttgggatggactatgtgggtccgctgacctttaattgtgtcagaagcctgattgggggagtggtcctgctgccctgtatctggtattttgataaaaagaggaaacgggaacgccaggtgcctgtcatccccggggccaggaagacacttgtggccggcggcgtgtgctgcggcgtggccctgtgccttgccagcaatttccagcagttcggcatccagtacactactgtgggaaaggcgggcttcatcactgcctgctatatcatcattgtccctatcctgggacttttctttaagaagaagtgcagccctgtgattgtgggagcggttgccctgtccgtggttggcctgtacctgctgtgcatgaccggcggggacctggctgtgaataagggagacctgctgatgctggtgtgcgccctgcttttttccgtccatatcatggtcattgactttttctcaccggtggtggatggggtcaagatgtcatgcatccagttttttgtgtgcggggcaatttcgggaatcggcatgctcctatatgagacgccggatatgggacagatcctggcggcctgggccccggtgctctatgcgggcgtcatgtcctgcggtgttgcatacacccttcagatcataggacagaagggcgtgaacccgaccgtggcgtccctgatactgagcctggaatccagtatatccgtcctggccggctgggccatcctgggacagaagctctccgccaaggaactggcaggctgcgccctgatgtttggggccatcatactggcccagctgcctgtgggaaggaaaagtcctgctgtggcagaggaaggatgatatccggcaggtccggcaggcggcagtatttagccgtgcctcctgtgcaggagcgcaatttgtcgtatccgggcgaagcctggcgagaatatccggttgataattacaggaaattaggttaagattataaaagcctgtccagaggacaggcttttaagaaagaatggtactgatatgggcagggcagaggaatatttaaatcagattcctatgtggaccaggaaaaagaattccctggaggatgtcagggacgtattggactccatgggggcgccggaccaggacataccggccatccatgtggcgggaaccaatggaaagggatctgtgtgtgctttccttacatccatgcttaaggaagccgggtataagacaggaaccttcatatccccccatctgattgaggtgagggaacggttcctgataaacggtgtcatggtggatgaggcagatttcgaggatgggtttgaaaccgtgctggaggccggcaggaagatgatggaaaagggatattgccatcccaccttttttgagttcctgttttatatggccatggtcatatttaaaagacaggatgtggacgtaatgatcctggagacaggaatgggaggcaggctggacacaaccaatgtcctgaagcacccctgcgcctgcgtcatcacctccatcagcctggaccacaccaagtatctgggcgataccctggaggagatagccggtgaaaaagccggaatcatcaaaccgggggttccgcttatatttgacaataatgagccccgggtgtccaccatactggagggatgtgcgttccgcaggggagctgcccgctatccggtgggaatggatgatttcagggtggtgcatgttggcggcgatggactggaaatcagtgccaggatgaaggatgaggcaagactgaagcttcagattccctttgaggcgctttaccaggctgagaatgccatgcttgcagtccgcaccctggatgtgctcaggcacggcggggaatgcagcaggaaaggcagccgggtcccgggccatgggccggtgggcgcggcaaggtgcattacctggaacattggggatgggcagattgccaggggtatcttaaagacggtatggccgggacggatggaacaggtggttcctggcatctatctggacggagcccataatcccgggggaatcaaggccttcatacagacggcaagggagatttccgcacgtctggaaaaacagcccttcctcttgttcgcagctgtgtcagataaggattacagggatatggaggcccggctttccgcaggaatcccgtggaaatgcatcggtgtggtccatattaatagtgacagggggctttcatccgaaaccctggcaagggagtttgaagaaacagccggctgtcccgtggttccttttgaggataccaggacggctgtaatggatatgaggaagcggagcagggacggtgtgctgttctgcgtgggatccctgtatctgattggggagattaaggcagttttaaacgagataggagttgagcatacatgattgattttgaagaggagattgagcgttttaaacccagccttgatgtggagcaggtggaggacgccattgtaaaaagcgatttgacggatatgacagacatcatgatggaactgataaaagaaagaggcgaaaaataggcggtggatatggactatgcaagaagaaaccagcagattgccaacagcttctataaccttggcctggagaagtccaggatcagggatctgtccggagcagcccagtgtctgaagaaaagccttcattttaacaaatatcagacagacgcccgcaacctgctggggcttatatactacgagaacggcgaggttgccgatgccctggtacagtgggtcatcagcctgaacctgcagccggaagacaacctggctgaccattatctggacgagatccagagaaagcccggccagctggaacgggaaagccagaatgtaaagacctttaaccaggccctgtggcatgcccagggcggaagcgatgacctggccatcctgcagcttgccagggtggtggaatccaacccgcattttgtgaaggcccaccttctcctggccctgctttatatgggacgggaggattataataaggccgggcgttccctgtataagattttacagatagacaagagcaaccagaaggccctgtattatatgtccattgtaaagcagaacacgggccgggcggacgctgagaagcgcaagatggtaaaagcattttcccacaggaaaatggaggatgacgatgtcatcatccccaatacttataaggagagcacagggctttccaccatactgcacatcatcatcggactggttcttggcatagctgcattttacttcctcatccttcctgccaggaccaaggcgctgaacaatgagaggaaccaggaagtcattgcctatagccagaagctgaacaatgcaaaccagcagtatgatatccttaaaacggattatgacaggctggatgcccaggcaaaagaagtacaggccaggctggacgagctgacaaccggcaataccagtatcatggcccagtaccaggggcttatctggatcctgcagaactacaggacaggagacctggtggctgccgccaaggcatttgcagaagccagctttgatctgattgaggatgagaatataaaggctatcgtggaaagcatacgccaggatatgacggccaatatataccagaacctggttgaccggggactgaccctgtggaacgcaggcaataagacagaggccatggattatttccaggccagcctgaccataaagccggataatcccgaggccctgttctatgtggggcgtctgtaccaggatgcgggcgacatggacaatgccaataccatgtttgataaggtggtcaatgagtttccggattccccttatgtggaaagggccaggaacgcaagaggatattaaaccagacatttaaaaatcaagatactacggaagataagcatgacgcgtcttttgtagtatctttttttatacaaaaatccagacacagcgcagaagaaaggagtatgaggacatggatcatacaatgtttacctatgaagccagggagcagactcttgtgatacaccttcctaaggaactggaccatcacaactgcaggaacctgaaaagcgatacggacctgcttctggaagaaaattatattaacaggattgtatttgattttacgcacacatcctttatggattcctctggaatcggcgtgctgttaagccgttataagcagatggcggccagcagggggcatgtatcctattatggggcgggcgcccaggttaagcggatactggaaatgggcgggatcaaccgcctgataaaaggatatgaggacagggaatcagcccttaaaggataagaggggagaagaaaaaatggaggataagaaaatggagtcaatgatggaaagtccccggtttgacaaagcggggaatggtaaggaacacttaaggcttatgatggacagcctttcacagaacgaggagtttgccagggtggtgacagccgtgttcatgagcaggttgaatcccaccctggaagaaattgatgatgttaagacggccgtgtccgaggccgtgaccaatgcggtcatccatggttatgggaaccagggaggggttatctgtatggacataacggcagatacagctgagggaatactgaccgtatgcatagaagaccagggtgtgggaataccggatgtgaagacagcaatggaacccatgtttaccacggatgagtcaggcgagcgttccggcatgggcttttctttcatggaggcgtttatggatgaggtagaggtacagtcggagccgggcaagggaaccctggtatcaatgaagaaattcatcggcaggtgacggcgatggatgagaccatgaaattaatcaatatggctcacgaaggggataaagcggcaagggaccagctggtaatggacaatgtaggtcttatatggagcattgtgagacggttttccggccgcggatatgagatggaggacctgttccagatagggagcatcgggcttatcaaggcaatcgataaatttgacacgggattcgaggtgaagttctctacctatgcagtgcccatgattacaggggaaatcaaacgtttcctcagggatgacggcatgattaaggtaagccgctccatcaaggaactggggtttaaggtaagggctgcaagggaggagatgacatacagcctgggacgggaacccaccatcgaggaaatcgcggccaggctggatacaagccgtgaggaagtggcggcatccatggaagcgggcgccgaggtggaatccctgtaccggcccacaggcaatggggatgataataccatgttcctcatggaccgtctggaggaagagaataatgaccatgaggaactgcttaacaggatggttttaaaagaactgatggaggacctgggcgaggagcagagggaaatcattgtcaggcggtatttttacaaccagacccagacccagattgccaaggaactgggcatctcgcaggtccaggtatcgcgtcttgaaaagcggattttaaaagaaatgcgaatgcgctatgaaaaataaaaaagtataaaattaatttttccatccatactaacaccagaaccaatcaaaccagtttacgaaaaggatgtgattatatgggttttgctaaacgtgtatgtgaaattctggctgtaatcggggcaattgtcctgattggaatcctggtatggtatctctcctccggtatgagggacaggggatatgaaaaggaaggcaccctggtatgggaagaacagaatcagctggctggggatagcccgaggttagaagaagcgtggaacgttgaggaggcggcatatcctgcttttgtgacagacccttcatccatgatttatggggagcaggagatacaaaggagcggtaaaggactatgaagaacaccgtctatgtgaaactcaaccagattacggagctgacccacaaggatgtggttttaaaggatgtggcccaggtttactgtgatgaccagaatataatgaataagtgcaatgccatgaaggtcaagaccattaaactggatgaaaagcggcgttacatcatgagcgccctggatgtcacacggaagctgattgagatggattccaccctggatgtgaaccatgtgggggaagtggattttatcattgcgtataaaccaccctctcccccggcttacatctggcagtggactaaaacggtttttgtctgtgctgtctgtttttttggggcggcatttgccatcatgacctttaataacgatgtcagcgtgacggatgtgttcagcgaggtataccgccttgtgatggggtatgaatcaggaggattcactgtgttggaagtcagctatagtgtggggctggcagtggggatcattgggttctttaaccattttgcctcggtcaagctgaacacggaccccactcccctggaagtggaaatgcgtctttatgaggacaatatcagtaagaccctgattgccgaggacggcaggaaggagtcaaaaattgatattacttaaaaaggcattgctggcattctttggtctgtgcgccggcggcgtcatcgcggccggcgtatatgctttcctggccatcatcggcgtgttcgtacgcctgatgggaaagacaggcaccagaaagcatatcatgctgtatgagacagtcatcatactggggggagtcctgggcaatatcctggatatctatgagttccccatctatatgggcgcgctgataggccctgttttcctgattgcggccgggttgtccgttggaatcttcgtgggctgccttgtcatgtccctggctgaaaccttaaaggccctgcctgtcatcagcaggaggatccacctgtccgtggggctgcagtacctgatacttggcctggcggccggcaagcttaccggttccctggtttatttctggtaccatatggcgtcgctgggataggacagtgatgccatgggcgctggtactgattgaaaaggagaaaagtaatggaagttgacaagaaaaaatatgaagaatatgtcaaggagataaccccggtccacagcctgcccaaaagcatggcctgcgccttcctggtagggggcgtcatctgcgtcatcggacagcttatcactaattatctgatgaacgggatggggatggaacaggagacagcggcggcctggaaccttctggccctgatccttatcagtattgtcctgaccggccttaacatttaccctaagattgtaaaattcggcggcgcaggcgcattggtgccgattacaggattcgccaactccgtggtggcgccagccattgagttccacgcagagggcgaggtgtttggcgtgggatgtaagatatttaccattgctggtccggttatcctgtacggggtcctgaccagctgggtcctgggactgctttattgggttgggggactgatgggtatattccagatttaaaacggaatacgtgccggtttttggcaggtgattgggatgggaagacattccaatcacctgccttttggcattttattttacttcattgagctggtgttccgcttcttttcctatgtccggtaatccgggcaattcacccatggttccgtcctttccgttgcttttttcattctgtcttttttattatagcaaagtaaaaggcagccgtacagatcatgacggcaaccccgccgcctataagaagggtttggatccttatcacatcggccagggggccgaataccatcatccccaggggaagggcacaggaggtggaaatctgcatgaagctgaatacccggccctgcatggaagcggggacctgttcctggatggataccgtgatgggggaattgtagcagggggatgtgattccaatcatcatattgcatgccaggtaaaacaggaataccggggccatgccaaggcccgccatcagcacgccgtacagccatccggccaggacagttgtttttaaccgcttcttaaatccgccccaggatgtgatcaggatgccgcccaggacagagccgatgctgtaagtcatttccgaggcagtgaggcgccatacctgcggtccgaaggtacggctgaccatcaggggcgtcaggaaggcggaggggctgataaggaacagcaccgctatctggaataacaggagatgccgtacaaaggaatctgtcttcagatagaggaagccctgtttcaggctgctgattccggatgatgtcccggcatgatcctccatcctgtccttcctgtatccgggtatggccaggacagaggtaatccccacgcctatgagggcggtaaatacatcgatgaacagtgttgtttccaaggtggataccgacagtatggcgccgctgactgccggagagaggaacatgataagggcggttatggtgctttggatgccatttacgcgcatcagatgctcctgcgggacaatctggggaatgactgcattgactgccggtgtctggattcccgtcccggcagaacggatcatgagcacggcaaacagcagccagatattcctgtgcccggataaaaaggcaatggccagtatcagggtggagagtgcaatgaccgtgtcggagagcatgatcagcatcttcctgtcatagcggtcaatccatacgcctgcaaacagggatatggcaatctgcggtgcaaatccgcatacggtggatatggtcagcatacgtcctgaggaagtggagagcgtcacataccagacaatggcatactgcaccagggaggagccaaagagcgatatggtctgggccgtcaggaatcgtgcggctgtatttttccaggattggttcatgatttgtgtaacctcatctttctatgattattttgggattttggcataataaaagggccgtggacagacactgtccacagcccaatccataaggacgtccgctgctccgggaaaatggtacagaaacaaggcgtatgcaatcgttcagaccatacgcgcagggccggccatgtttcccgatgaataaaagcagttaaacgcccagtttaagctccgtacaatgcttcaccggatacaattgtacagagctgattcgccttctcatcctgtccgtaacatagaaccataccataagacaggcctccttcatatgtttcatgtgaatttactctaacagaaatattttatcctgtcaattgcctattatgactaattttcgggaaatgagagatactgataatgaatatatcctgtcagaggaaggagaatgcataagatgggacagatgaaaggaaaggcaagtatagagtttgaacacccgccagtcattataagcgccggggcggtggttggtaaaaaagaaggggacgggcctcttggacagctctttgaccaggtggagcaggatgacatgttcggcaaggataactgggaacaggcggagagcgccatgcagaaaagaaccgcggaccttgtgattgaaaagggcgggatcaggaaaagcgacctgcgctacctcttcgcaggggacctgctgggacagctgattgccacgtcctttgggaccgtggatctggagatacctctctttggcctttatggggcctgttcaaccatgggggaggccctgagccttggcgccatggctgtgaacgggggatatgccagccaggtcatgtccatggcatccagccattttgcaacggctgagaaacagttccgttttccgctggcctatggcaaccaaaggcccatgtcagccacctggaccgtaaccggctgcggcgctgttgtcattgcaggggacaggaagagcggccttgcaaggattgcaggcatcaccacgggccgtatggtggatatgggagccaaggattccatgaacatgggagctgccatggcgcctgccgcgttccataccatagaacagaacctggaggatttccaggtcaatgaaacatggtatgacaagatcatcaccggggacctgggagaagtgggcaggaccatccttttggagttcatgaagaacaaaggaagggacctgagccagatccacatggactgcggaattgagatatatgataaggaacagcaggacacacatgcaggcgggagcggctgcggctgcagcgcggttacactgtgctcctatatcctgcctaaagtacaggacggtacatggaaaagggtgctgtttgtccccactggcgcccttctgtctacggttagcttcaatgaaggccagagcattcccggaatcgcccacgcagtcatcattgagcacattgacgattaaggaggtatcgacatcatggactatgtgaaagcatttttaattggaggacttatctgcgctctggtgcagatcctgatggaaaaaacaaaaatgatgcctggccggatcatggtaacgctggtagtaaccggatgtatccttggagccatcggcatatatgagccgtttgcaaaatgggccggagcaggagcaggggtaccccttctgggatttggcaataccctctggaagggggttaaggaggccatcgggaaagacggggtgctggggatttttaaaggaggcctgacagccagctcggccggtatatgcggggcgctggtattcggatatctggcatctctggtgtttaagcctaagatgaaataagaggctgtctgcctggaaatccatgcaggtaaaactttgtactttgccaaggcttcttttttatcatattatgggccgctcacgatttccttactatcagataggggaggaagcaggattaaaaagcagtggaggcagaacaaaaataagcccaggaatgccccgggcttatttttgttgttcttcattattgttcttaattacttatccgcacataagcaatgggcctaatatggtatattccccggtccataaccctctgtgggcggagctgacgtggaaggctggtagccaggcccgataggtgaaacaatggggctgtcgcctccggtttcgtccgggtttggattgatgatggtggaaacatccgtgtggatgttgcagtagcctgggatggagaatgctgaatcatccgtggcgcctgtctctccatccggaagcaccatgcagaccctggtggtcttgttggggcagtagggcgttggacgcatgcctgagtcagcacatacagtcaccgccacatgcttatcgcacacttccgtgggagctgttccctttgcaaaatattccgtataaaccgcgttgcctcttgggtcggccgtacatacgcctgcaacggcgcgcttgccggacttacggcagatttccgcggtctctatgctgtccggtatggcaaagccggggtcggacttgccttcatggatacggttcatgatgttgcgccatatatccttgtggaaggaggttccgccgttattgacattaccgtgtttcagcttctggttgttgtcacatccaccccagatgcctgctgtgtagtaaggcgtataccccacgaaccagatatcattgttagcggtagtggtaccgctcttgccggcagcggacattccggtcagcgccgacctggtactggtggagttgatggatatcccggatcttgcaaacaggcggttgctcttcatggattcagccatggcgtccgtgaggaggaatgcagtggaatccttcaggacctgcttggtttccggttcattgtctataagcaccttgccgttgtggtccagtatctttgtgaagaaacgcggtttggtatacacgccgccattggcaatggaagcataggcagcagtcatctccaggttggaaactccttttgtgatgccgcccagggcagtggccgcgcccaggtcgtccttgaccagggaggtgatgcccatgttctccgcatattcaacgcccaactgtggagtgactgtctccatcatgcagcggaccgcaatcacattcatggaatagatgataccgtcacggatattgtgatagcccacaaatccataaccggagttccaccagttcctgaaggttttggtaccgatggtataagtggaatcgtaataaaccgttcccagggtagcgccgcaggcatccagcgcaggtgcaaaggaagtgatgaccttaaatgcggaaccaggctgacggtagacattgctggcacggtttaaggtaaggctggccttcttctcaccgcggccgccgcagagcgccttgatttcacctgtgtgctggtccatcagcacaaaggaagcctgtggctggaggattggattctggcgttcgcctatgatttcgtccccatcctttaacagccactccttgtaggagtcgatatcggactggattgcgtcctcacttgcgtaaaggccctcaaaggaggtgtcccgcaggattgtcttgcggtagctcttgaggttctcctcggaataatgctccgtggtgccgtccgcatgggtgacactgagcctgtattccacggaatacttggcaacggaatagttgtccggattgttgatttcctcatccacgatggcctgaagttccgggtcctgggtggtgtaaatctgaagtccgccggaatacagaaggttgctggcctggctttccgtgtaatccagcttttccatcagcgctgttatgacctgctcaatcagctcgtccgtaaaataactgtagtggttattggtctccttggtagcggtatccacattctggatcctgtcatagacatcatctgcaagcgcttcctcctgctcctccttggaaatgaaaccctggtcatacatgtactgcagtacgatctggcgccgctccgcattcttctcccgtccggatatggggttcagtttggacggattcttggtaatggaagccagcaccgcgcattcggacaaggtcaggtcggacaggttcttgttaaaataacgtttggcagccaccttcacaccaagggtgttgttgcccaggttgattgtgttcaggtagttggtgatgatcaggttcttggtgtcttccttgctcatgccggaattcttctccagctggaccgcaaggtactgttcctgcagcttccgctcaatcttggcgccccagcctgactccatgccgccggaaaatacattgttcttgatgagctgctgggtgatggtgctcccgcctcctgcatagtcatcgctgatgacgccctttacggcacgggcaatggaacggatatcaatgccgttgtggctcctgaaacgggaatcctcaatggcaatgaaggcattgaccaggttctgaggaagttcctcatatgtggctgattcacggttggaaccgctggtgaccagtgtgtccgtcaggttgcctgcagcatcgtaaaccgtggtggcaaagcggtcaggctggatgtttaagatatctacggagggggcattgtcaataatacccttaaccataccgaaaccgatggacgcgcccactactgctaagaaaagaaacaggacaaacagggccttaaatatattaaggaacagccgcgaggcgtatttgcctgatttggagtggagagacttgatcctgcgttcagtctcatacttaccatagttcatatattctcctttatcgttccacgattccttttcgtggactttccttaatcttcccacgattcctttttcgtgggttttcctttacctttccacggttccctaaaccgtggcctttcctacataaagattaccttcaaagtctatcctgtagattatacaccagttttgtaaaattgaaaaggtttaaatatgcccttgccatcgccgtatttctatattatgataaaaaataggcaaaaacaggtcggaatgtggggaatgatacccttaaattggaacaaaggagtatggaaagtggtagagcgttacaaaatagtatatcagggcggaaccggggagctgattgagaagaagtccaggttcattgcggatataaaaccggtggccagtgaggaagaggcgctggcctttgtggaggagatgcgaaggaaatactgggatgcaaggcatcactgctttgcctatatcataggcgacagggggcagacggccaggtgcagcgatgacggggaaccctcccagacagcgggcaagcccatgatggacgtgctggccggagaggggcttcacgatgtgtgcgccgtggtgacccggtattttgggggaaccctgctcggcacaggaggcctggtcagggcctactccggcgcgctgaaggaaggtcttaaggcctgcgtggtggtggagaaaaagctggcctcctgcctggaggtcaggacggattacaacggcgttgggaaaatccagtacattgcagcccagtcaggcattgataccctggacagccagtacacggaccaggttctgtttaccttcctggtgcctgctgctgaggaaggccgttttaaggcccagctgacggaagggaccaatgggcgggcttccattaagaacgtggatgaggtctattatggcgttgttgacggaaaagtcattgttttttagaagaaaattccgtaatcagcggcattttcccgtaaaatcccttgcattatgtaaatagcaatgctatactataaaaccgtggctgtagacgtatataattaaggaagagtaatcactatgaagatgaaaagagaagatgtaagaaatattgctattattgcccatgtagaccatggcaagaccacattagtagaccagctgttaaggcagagcggcgtattccgtgtgggccaggaggtccaggaacgcgtcatggactccaatgacattgagcgcgagcgcggtatcaccatcctgtccaagaatacggctgtattttataaagatactaaaatcaacattatcgacactcccggacatgccgactttggcggggaagtggagcgtgtgcttaagatggtgaacggagtcgtgctggtggtggatgcctatgaaggccccatgccgcagaccaagttcgtgcttcagaaggcgctggaactggatttatccgtgattgtgtgcatcaataaggttgaccgcccggaagcgcgtccttcagaggtgattgacgagacgcttgagctaatgatggaccttgacgcatcggatgagcagcttgactgcccgtttatctttgcgtccgcaaggggcggatttgcaaggtatcacatggaagatgacaacatggacatgggtcccctgtttgagaccatcatcagccatacgcccgccccggaaggtgacccggacgcggacacccaggtgttgatcagcaccattgattacaatgaattcgtgggccgtatcggaatcggaaaggttgacaacggcggccttaaggtcaatcaggaatgtgtcctggtcaaccatcatgacccggataaattcaaaaagattaagataggaaaactctatgagtttgacggtcttaagagggtggaggttcagcaggcatccgttggttccatcgtggcgatttccggtattgcggacatccatatcggcgataccatctgttcaccggaccatcctgaggcaatcccgttccagaagatatccgagccgaccattgccatgtacttcatggtaaatgacagccccctggctggccaggaaggaaagttcatcacctcccgccacctgcgtgacaggctgttcagggagctgaacaccgacgtaagcctgcgtgtggaggagacggattccgctgactgcttcaaggtttcgggccgcggcgagctgcatctgtccgtactcatcgagaacatgcgccgcgaaggctttgagttcgcggtgagcaaggcggaagtactgtacaggtatgatgagaggaaccgcaagctggagccgatggaactggcttatgtggatgtgccggaggaatacaccggcgtggtcatccagaagcttacaagccgcaagggcgcgctccagggcatgagccaggcagcgggaggatattccaggctggaattctccatcccttccaggggacttatcggataccgcggtgatttcatgacagatacaaagggaaatggtatcctcaatactatttttgatgaatatgcagagtacaagggcgacctgttctaccgccagaccggctccctgattgcatttgaggcaggagaggccattacctacggcctgttcaatgcccaggaaaggggaaccctgttcatcggaccgggaaccagggtatattcaggtatggtcgtaggccaaagccccaaggcggaggacattgaaatcaatgtctgcaagaccaagaagctgaccaacacgcgttcctccagcgcggacgaggcgctgaagctgacgccgccgaagatcatgagcctggaacaggccctggacttcattgacacggatgagcttctggaggtaacgccggaaagcctgaggatccgcaagaagatcctggaccccaccatgcgtaaaagggcgtcctttaagaagtaaaaacgacataatcaaacacaaaaaggcggatcctgtcgaaatgttctggcaggatccgcttattttttggtctattatggtaaatttcctcataaactatcaatgtgccgtacgaaagcaagctgaacagaaagaaaaaaataaaaacggccaagtgagaatttatttagaagcgaagaggagatgtactatgtcagaaaaaatgattgaaaacaacaaggtaagtgttatcggtgagattgtatcgggatttacctttagccacgaggtatttggagaaggcttttatatggtggatgttgctgtgaaccggctcagcgagcaggcggatatcatcccgcttatggtgtctgagcggctgttggacgtacaccaggactattcaggaagcaccattgaggcgctgggccagttccgttcctataaccgccacgaaggggtgaagaacaggctgatgctttccatctttgtccgggaggtccatttcatggaagaatttacggactatacaaaaacaaaccagatattcctggacggctatatctgcaagccgccgatttaccgcaaaactcctctgggccgtgaaattgcagatatccttctggcagtcaaccgtccatacggcaagtctgattacataccatgcatcagctggggacggaatgcccgctatgcatccagctttgaggtgggcgccagggtgcgcatatggggccgcgtgcagagcagggagtacaccaaaaaactcagcgagaccgagtgtgagaagcggattgcctatgaggtttccatcagcaaactggaatgtgacgaggaataatcttttaagactctttggaatttctttcggaaaaagtaagaaatatttgcaaagttggtcaaactatgctattatgagcaaagtctatgaatgaaacatcattcttaagaaaaagcaagtaaagcatgaggtgcatgatgatgaaagaaagcatgatacaggttatctgcgggccgggcaagggtaaatcaacaagtgcaatgggcaggggaatcagtgcgctggccaagggcagcaatgtaatcatggtacaatttttaaaaggttccctggacatggataacatggaaatcctgaaacgcctggaaccggaatttaaaattttcagatttgagaagactcctgttttttttgaccagctgtcagaggaagaaaaggatgaggcaaggatctgcatccgcaacgggctgaattttgctaagaaggtcctggtgacaggtgaatgcgatatccttatcctggatgagatacttgggatcctggatgaaggcgtcattacccaggatgagctgtgcgcccttatcggccaggcaaggcaggctgaaatcaggctcatactcaccggcaatgtgtatccggattcactggatgcatatgtggatgaggttacgaagctccagaccagatatgaatgagatttcctgttgacatccatatcataggatgataatataataccaacaatcatagagtagaggttgcgtcaatcaagagtaaccaggcccgatgtggcaggcacagaggacggcttggggaaagggaaagacgccgaagggggaagcatacctggaacatgtttctttctgggcatatggtgaacatccatatgactgtcatccgggtggatggagagctaccgaagaacgtggattcgtgaatgacgatatgatacgtacgtgaagggctgacatttacctcagcccttttttgctatcctgtgattgaaccaagagaaaaggagagaataaattatggctatttttgaaggagcaggcgttgcgctggtaacaccatttaaggaaaatggggaagttaactatgaaaagctggaagaaatcgtggaggagcagattgccgggggtacggactccatcattgtctgcggaaccacaggagaagcttccaccatgagccatgaggaacacctggatgtggtgggatatgtgtgcaaggtgaccggaaaacgcatccccgtcattgcgggaaccggatccaactgcacggagacagccgtttatctttccgtggaggctgagcgccgcggggccgacggccttttactggtatccccttactacaataaggccacacagaacgggctgaaggcgcattttaaggcggttgccgatgccgtaaagattccaatcctcctttataacattcctggaaggaccggtgtcacgatccttccccagaccatagccgacctttgtaagaatgtggataacatcgtgggcgtaaaagaagcaagcggtaatttctcagccattgcaaccttgatgagcctggctgacggcaaggtggacctgtattccggcaatgacgaccagatcgtacccctgctttccctggggggtaagggcgtgatttccgtgctttccaacgtggctcccagacagacccatgacatctgcgccgcttattttgcaggggatacggcgaaaagcgccaagctgcagctggatgccattccgctgattacagagctgtttgcggaagtgaaccccattccggtaaaggcggccatgaacctgatgggcaagaatgtgggaccgatgcgccttccgctgaccgagatggaaccacagaaccaggagaagttgaaagcagccatgactgcatacggcatcctgtaaactaaggctggaaaggataagacacagatggtaaaaatgataatgcacggctgcggcggggccatgggacaggtaatcacagggctggccgcagaggatgagtctattgagattgtggcgggaattgacttacatcccgcaaaggacagcggttatcccgtatttgaaagcctggatcaatgtaacgtgaaggcagacgtgattgtggatttctcttcggcaaaagccgtggacggacttttaaaatactgctccgaaacaggtatgccggtggtgctgtgtaccaccgggctgtcggaagcacagctggagacactcaaacgcgccagcgccagcgctgctgtgctgcgctcggccaatatgtccctgggcgtcaacctgctccttaagctggtgaaggatgcggcaaaggtacttgccggttccggctttgacatcgaaatcgtggaaaaacaccacaaccagaagatggatgcgcccagcggcacggccattgcactggcggattccattaaccaggccatggatgagccttacgggtatatctatgacagaagcacccgccgtgaaaaaagacacgcgtcggaaatcggcataagcgctgtcaggggcgggtccattgttggggaacacgatgtgattttcgccggcagggatgaggtggtcacgttcagccataccgcttattccaaagccattttcgcaaaaggcgccctggaggcggcaaagttcctggcaggaaaaggcccgggactctataccatggctgacgtggttaaattgtaggaaatattttcctgagatagcaggatataccaccataatatattctccaaacgcacataataagggtagaaatagaaaggagaatgttattatgaaaaaaatcagacctgctatcttagctatgttactattcgttatggttctatctgtgacggcctgcggaagcaataattcaggtacccagtccaccacaggttccagccagtcttcttcatcggcagcaacatccacaaccgctgcagggagtaatgagagcagcagcaatacatccggttccgaaaccaccggaggcgtgcttgacaatcttgtagatgacgtggaagacggcgtggatgatgtgggcaacggcatcaaggacatgaccggcgaatcaggtaataccagtgagaccagcaacactgccacaacagaggcaacacactaatcattattctatggtatttattgcagggcggaccctttcttggccggtgaggcagggaaagggttccttttgcattgctggcgggacagggagtggggacttttagcttatctgctggagctggggaagaatcccctttgcgtatctggcggggcaggaaaagaacgtttttaacttggttcagggtcctgaggaatgggtgttctggtcttgatatggaaccggggatgaactataatgaccatatgcggccggattggagaggatgcgggaaaggagccaggaatgggattcctgaaccggaggatatgtggctggaatcataagaggatatgtggctggaatcataggatggtatggtggaagtcatattggcgcagaagatggcttcgcctgtacagaagccatatgattaagatgtggaagggcagggggaatgagggacacaggcggatttataggcaaaaaacaaggaagagaaaaaaactcataagcaggacggtgaagaggaaaaaacacattacgagaaaaatctttataattgccatagggatggttgtatattggaatgcatccattcgtggaggatttttcgcatcgttaaaagacatggtccggatccgttatatggaagaacaggatgcggtacgggatcatatgaccagcaatgggcgggtggaacctgcaccggatggggaaaggatggaaaaggatggccgtcatggggggaagattcagaaggaaggcgtgactatcattctggacaaagggtctgtgagtattttccggttggaggaacacatggaaccagggagtgattagaaggggatggaaaattcattaggaattttaatgattgcacttcttgtattcaactggatattgtattataatttcttctgaaatggtattcttttatagcgccagcttataaatctatatcttatatctatgttaccatatgaataaaagaaaaggacaggtggatacccatggaaaagaaagagatgctctatgaaggaaaggctaagaaagtctatacaactgaggacccggatgttttaatcgtatcctataaggatgatgccactgcatttaacggattaaagaaggggaccattgtgggcaagggggccatcaacaaccgtatgaccaacttcatctttaagaagctggaagaaaagggtgtgcccacccacctggtggaagaattaaatgacagggagaccgctgtcaggaaagtggagattgtgccccttgaggtaatcgtgcgcaactattccgctggcagctttgccaagaaaatgggaatggaggaaggcatcaggttcaaatgcccgaccctggaattcagctacaagaatgatgacctgggcgatccgttcatcaacagctactatgcgctggcacttggccttgccacccaggaagagattgatgacattaccaaatatactttcaaggtaaacgaagtgcttcaggagtattttgacggcctgaacatcgatttgattgactttaagattgagtttggccgttaccacgggaagataatccttgctgacgagatttcccccgatacctgccgcctgtgggacaaggacacccatgagaagctggacaaagacaggttcagaagggatcttggcaatgtagaggatgcatatgaggaagtgttccgcagactgggaatccagtaatgaacttacatacaacgcctgggcattgattacccaggcgttgcctgattcaatgcttttccccgattaaatcaatcggggactttccacatgacttatagagaaagggacttgactgaatggagcagaaccagttggactttgacattggggcagataaactgcgcgaggagtgcggggtttttgggatttatgattttgatgggaatgatgtggcatctaccatttattacgggctttttgccctgcagcacagggggcaggaaagctgcggtattgcggtcagcgacacggagggaccgaaggggaaggtaagcacccacaagggcatgggcctttgcaacgaggtgttttcaacggaacatctggagcagatgcacggcaacatcggggtcgggcatgtgcgttactccacggccggaagcagtaccagggaaaatgcacagcccctggtgctcaactatgtaaaaggcacccttgcattggcacacaacggcaacctggtcaatgcgccgcagctgcgccacgaactggaatactcgggagccattttccagacaaccattgattccgaggtgattgcctaccatattgcaagggccagggtgtccgtgcccaatgttgagagtgcggtggcaaaagccatgggcaagctgaagggcgcctattcccttgtcatcatgagcccgcgcaagctgattggggccagggacccctttggattcaagcccctgtgcattggaaagagggataatgcctatatccttgcatcagagacctgcgcccttgagacaatcggagcggagtttgtgagggacgtaaagccaggggagattgtcactattaccagggaagggattgcgtccaatactgaaatgtgtttcagggatacggaaaaagaggccaggtgcattttcgagtatatttattttgccaggccggacagtgtgtttgacggggtaagcgtgtatcactccagaatccaggcaggccgtttcctggccctggattcgccggtggaggcagacctggtggtgggcgtgcccgaatccgggaacggggcagcccttggttattccatggaatccgggattccctatggaaccgcattcgtgaagaattcctatgtgggacggaccttcataaagcccaagcagagcagcagggagtcggcggtccggattaagctgaacgtcctgaaggaagcggttgcaggcaagcgcatcatcatgattgacgattccattgtgcgcggcaccaccagcgccctgattgtgaacatgcttcgggacgcaggggccagggaagtccatgtgcggatcagtgcgcctccattcctccatccctgctactttggcacggatatcccgtcagaggaccagctgattgcccacgggcatacggtggaggagatacgggagatgattggcgcggattccctttcttacctgaaaatggaacggctacaggagatggcatgcagccgctccatatgcacggcctgcttcagcgggaattaccccatagatccgccggctgaggatataaggggaagctacgataaataaacagcggttgaagacatgcacctgttgtggtaagataaaaaccatgaattgaggaaaaaccatgatggacaatcaatggtggaaaagtatggaggaaatgacatgagtaacacagacagatatgtaagccctctttccgagcgctatgccagcagtgagatgcagtatatcttttcgccggatatgaaatttaagacctggagacgcctgtggattgccctggccgagactgagaaggaactgggtcttggcattacggacgaacagattgaggaactgaaggcccatgcagatgatattaattatgatgtggcaaaggcccgtgagaaggaagtgcgccatgacgtgatgagccatgtgtatgcttacggggtccagtgccctaaggcaaagggaatcatccatctgggagccacatcctgctatgtgggggacaatacggatatcatcatcatgacagaagcccttaagctggtaaggaagaaactgctcaacgttttggctgaactggctaagtttgccgacacctataaggaacttccaacccttgcattcacccatttccagcccgcccagcccacaacggttggaaagcgcgccaccctctggatgatggagctgaagctggatctggatgacctggattatctcatcggatccatgcgccttctcggctccaagggtaccacaggcacccaggccagcttcctggaactgtttgacggcgaccatgacagatgccgccgcctggatgagcggatagccgggaaaatgggattcgagggctgttatcctgtttcaggccagacctattccaggaagattgacagccgtgtgatcagcgtcctggcaggaattgcccagagcgcccacaaattctccaacgacatccgcctgcttcagcacctgaaggaggtggaggagccatttgagaaaaagcagattggttcatccgccatggcttataagcgcaaccccatgcggagcgagcggattgccagccttgccaattatgtgatgagcgatatgatgaaccccatgctggtggcctccacccagtggtttgagaggaccctggacgactcggccaacaagaggctttccgtacccgagggcttcctggccgtggacggtatcctggatttatatctgaacgtggtggacggccttgtggtgtatccaaaggtaatcgaaaagcacctgatggcggaactgcccttcatggcaaccgagaacatcatgatggatgcggtgaaggccggaggcgaccgccaggaactccatgagcgcatccgggaactgtccatggaagcaggaaagaacgtgaaagaaaaaggtctggataacaatctccttgaactgattgcagcagaccctgcattcaatctttccctggatgacctgaaggcggccatggacccatcccgctatgtgggacgggcgcccaggcaggtagaagagttcctggaagaggtaatccgcccggtgcttgcagacaatgcaggggaactggggatgactgcggaaataaatgtgtaggttggatttggtaatgtgagggggttgcggatgctacgtccgcgaagcgggccaggacgggctttgccctaaggggaaccggccggggccggggggattccttaggacgtctgcgggacggacgccaagctccggaggggcagcttctaaggccctgacaagcggaaagacggggaccggtgctattcgctgagaaatcctgaaggactttctcagctcagagcaccttggattcttgctttgatgcaggaatccaccccgtctttccgcttgccagaacctaagaagctgctccctcctccacaatgcgcccgcccctcagccgccctaaggaatccccccgtccccgcccgctccccctcagcccaaaacccgtcctggcccgcttcgcggactgtgtattccagccatgacatgcgccaaacgcaggagtggaaataaaatctccggcgccagctgtttccagaagatatgggatggactggcggggggatttttttatttttctagttggattcatgagatgcagggatggaggaacgtggcgggtgagcggaagggggatgggggtgtggatgcatctacagggacgtgtgggtcttaggctgagggaagcggtgctaagaggctggcgcctttgtctgagcccgatgactgaatgggtggtaacacctgaagcgcgagtttggcagccagcctcttgtccagcgccgttttcctcagccttagagccactagtcccgcagccgtatccgcacccccatcccccttccgctcacggacggatgcacctcaccccacacctcataaatccacgttcccatattgcgaacctcggcaaggaatggtatagttttaatataagcaagtataaggacaagtcaacaagaacaaaggaaagggaggtcatgaatgaatgtaaatctggaatattacagggtgttttactatgtgtgcgttcatgggagcctgactgcggctgccagggagctgtgtatctcccagccggcagtcagccaggccgtgcgccagctggaaaaggaagcgggaatcaagctgttcctgcggacatccaagggcgtacagcttaccaaggagggggaactgctgtaccgctatgttaaagtgggggtggagagccttttggaaggcgagaagatggtggaacgggtcctgggcatggatatgggggaggtgcggattggggccagcgatatgacccttcagtttttcctgcttccttacctggaacagttccacaaggagtttcctaaaattaaggttaatgtatcaaatgcgcctacgccggaaaccataaagagcctggaagagggcaggattgattttggcgttgtcaccactccctttgaatgcagggggaccatgaaccggattccggtcaaggtcatacgtaatgtgttcattgccggcaacagctttgaaaagctgagggacagggagctggattattcggagctttcaggcctgccctgcattttcctggaaaagaataccagcaccaggacattcatggatgatttcctgttaaaacaggggattgaactgaagccggagtttgaactggctatcagcgacatgatcgtacagtttgccaagcgcaatatgggggtgggctgcgtgatggagggatttgcccaggacgcggtggaagcaggggatgtatttgaactgaaatttaaaatggagatgcctgcccggcatatttgcgtggttaccggggaatctaaccttatatccatgcctggacgcaagcttctggaaatgattaccggccagaggattgatacggatatgatataagtgctcattatgggaagcataataaagaacgtctttacttatgaagggtgttgtagtaaagtaagaactgtcttttttgagtttgtatcagactcagaatagggcttaaggaagataatgagcatggacgggaagatacccgaaggaggatttattgtatggtcagagcaattgtaggtgctaactggggcgatgaaggcaagggcaagattacggatatgcttgccaaggagtctgacattattgtacgctttcagggcggaagtaatgcgggacataccattattaacgattatggcaaatttgcccttcatctccttccatccggcgtgttttatcagcatacaaccagcgtgattggcaatggggtggcgcttaatatcccatatctgatggatgagatacagtcactggtggacagaggggttccaaagcccagggtccttgtttcggatagggcgcagatcctgatgccttatcatgtgctgtttgacacctacgaggaagcgcgtctggcaggcaaatcctttggttccaccaaatcgggtattgccccgttttattctgataaatatgccaaaatcggtttccaggtcagtgagctgttcgacgaggagcttctgaaggagaaggcatacagggtgtgtgagcagaaaaatgtgctgcttgagcatctgtaccataaaccgctgttagatccggaggagctgctcagtgagctgcacggttaccgtgacatgattgagccatatgtatgtgatacatccgcgtatctctatgaggccattaaggagggcaggaaaatccttctggaaggccagcttggttcccttaaggacccggatcatggaatctatcccatggtgacttcctcatccaccctggctgcatacggcgcaatcggcgcagggataccgccatatgagattaaggacattaccacggttgtaaaggcttactccagcgctgtgggcgcaggcgcctttgtcagcgagatattcggggatgaggcggaagagttaaggaaccgcggaggcgatgggggcgaatatggcgcaaccaccggacgccccagacgtgtgggctggttcgacgcggtagcgaccagatatggctgccgtatccagggaaccacggaggtggcatttaccgtgcttgatgtcctggggtatctggatgagattcctgtgtgcgtgggttatgagattgacggtcaggtaacaaaggaattccccaccactgcacggcttgagaaggctaaacctgtgcttaccaggctcccgggatggaaatgcgacatccgcgggattaaggattatgaggaactgcctgagaactgccgcaaatatatagagttcgtggaaaaggagattgaggctcccattgcaatggtctccaatggaccgggacgggatgacatcatcatgcgcagccgttaaaaggcggtgatataaaagattttgtatttaggatacaaactgtcgggaaacctgtaggctttctggcagttgtggggctgtctgaggtcagatggaaggggtggagaaagggaaccaaagaaagagggggttacgttgaaaaaagaggagagacaaggggcagggagaccgaatgtctgtgatagatgtccattttgtgggacaaagtgacggggttacctggcacaacaaattaaaaatgcttcatcctgttttatatcggaaaccttgacttttctaggaaaaaatgggtatgcaaggtcaattgggaatcatcgtaacttagcataaaaatatcatatgaaattgccgggatttgggacctttttgagactaaattgggattgaaaatggtcttgactgcttaaggggattttgcctgatgtttaaatgttagcaagagtcagcaaataggtatacgtaataagaatgctgatggcacactattgaggaattggtagtgtgccgtttttgcgttttagggaaggaattactaaaaaatgtaaatctaccaagcaagtaaaatgtaaagatacatataatattgaatgagactttgcttgttctaatttatgaaggcgattatttttaggatgatagagggatttaggaataagatgttttatgaacaaacaggaaaccatggcagtttattgctaactttggttggcataattttataagggagaaaaaagatattgaagagtcagtgttacgaggttgtgggagtatgtccgttgattgacaaagtcacaaaaccaagtataataatattaatgacattgttgcaattgtcaggaggacaagcatgtaggatgtcaatgaactgttggaattagtatttaaggaaactgtaaatcttaatgacgacgaagtttttcttgtgaaagaattgttcagaagtatgaatggaataggataccgtgtaaggacagattattacttggcacactttttctaagctttattaacaaggatactaactcaatacgagtgattgaaaaaacgcttttggacagtaaaaatataggtatatcatgatgaatgacaatcatttacagtctgatgtacaaaagagaaaagttactatgtaacggagaggatattcagcatgaaaagtatatcgctaccaccctatgctccaactcttatagaatctactcgtgctatcggttatacattagaatcagcaattgcagatatagttgacaatagtgtatcagcttttgcttcttctgtagatatttttttctatccaattggtgattcatatattgcgattttagatgatggcaatggaatgactgctgacgaacttgagacagctatgcgatatggaagccaaagtccgaatgaaaaacgtgaggtcagtgatttggggcgttttggacttggattaaaaacagcttctctttctcaatgtcgaatgctgactgttgttagtaaacaaggggggaatattgttgggtgtcgttgggatattgatcatgtagctgatacaaaagactggtcattattggttcttgattcagatgcagaaatagatggtgttccgcgtattgaagagctgaaacaattgaattcgggaactcttgttatatggcagaaccttgataggcttaagattggtgaacttgattttgaccgttcaatgggcaaaaagatgaacgatgtccggttacatctttcattggtatttcatcgctatattagtggtgaacaagggttaaagaaaatgcagattagaatgaataatagtccgattgagccagcagatccatttctgacacggcgtaatacacaggtaatgtcagatgaagtcatgaatattgaaggatcagcagttgttattcgcccgtacatacttccgcatatatctaatctgtcttcgagtgaaatatctgcacttggcgggaaggaaggacttcgcaaaagtcaaggtttttatatatatagaaataaacgtctattgatatggggtacatggtttcgcatgatgcgccaaggcgaactttctaaattagcgagggttcaagtggacatcccaaatgaattagataatctttggacattagacataaaaaaatcgactgcaatgccgccggaagcagtgaggaataatcttacagcagtgatagagcggctggcagagaatagtaagcggacatgggtataccgtggaaaaaaagaaaccctggattctgttgttcatgtttggaatcgatttaaaggcaagcaaggcggtttctattatagcataaaccgtgaccatcctttggttgaaatattttcaaattcaagccctcaagttaagcgaaatgttgagaatttgctaaaagctatcgaaaacagcataccgttaaatcaattatatatcgacttgacttctgaaaaacaggttgaaaatgaaacgctgactaccatgcaggaagttgaaagttttttattgggattgcttgaacaaatctcaacagaagctggtaaggcggaactattagaaagtcttgctgtttcagaaccgtttattcattatcctcaaattataaataagtatcgaacaggaggtacctcacatggcagcaagtaatattgcacaattagaaggtttaatttcttctagtgtgaataaagaatatcctgactacccgccaactgaagcacaatttgaagagatggcgacgaagattcgtgatttaatgcaccctatgtatccagttgacgacatagaatttgcggaaattaggcgcagacttagggctaaggttgcagttcggatggatttaggcattgctatcattgataacaaatgtttgcatcagtcttggcttcctgcacgccgcgctgatttggactttttcttctggaaaagatacaagatatatcttgaggaagtaaaaggctggaatgcacgtgtctctggcagccttgatcgtgtatctgatgaaattgttgatttgcttggagatcctaaaagtgatgaaccattccaacggcgcggattggtgcttggtgatgtacagtctggaaaaacggccaactatacagctatttgtaacaaagctgcagatactggttataacgttatcattgttcttgcaggcatgatggagaatctgcgtcagcagacacaggaacgtctggatgcggagttttccggaagaaagagcgaataccttcttgaccctaagcgtgacatcgaaaacatacctgttggtgtaggtaagtatgggcaggaaaaaagaattgagtcttttacgtcagttgttaaagattttgacaagaatattcttcgtcagctaagcctttcgctgcagagtgtgaatacaaccgtagtatttgttattaaaaagaataagagtatactgaataatcttatccgctggcttaaaagtaacaatgctgatactagaggtgtaatcagtaagtctcttttacttattgatgatgaagccgataatgcatctgtaaatacaaatgattcggaaaaagatccaacagctatcaataaagcaattcgggaattgcttaagttattccgtcaggcatcttatcttggaattactgctactccatatgcgaatatattcataaatccggataatgaggatgaaatgaggggagatgatctttttccgagggattttatttatgcattatcaccgccaaccaattatattggtgcggaagatatttttggcggcgatgaagataatcctgctaaatataaggatgttctcgaaccaatttatccaatagaaatggatgcttttttcccatttaatcaccgcaaggggcattctgtgtccgaacttccgccgagtatgaaagaagctatggcatattttttacttgtcaatggcattcgtgatattagaggagatgtaaatacacatcgatctatgcttatccatgtcagtcgttttacagatgttcagaatgaaattcgtgatttagtaactgcttgggtaatacaggtacgttcagatttacagaattatgccagcctatctgaacaagagagcgatggtatttctagtattgcataccttaaagcggtttgggaaaaacataaacttgctgaaaaggcgggtaagtctggattcccaatgttatggcatgattttttgtcaggctatctttttaaggcagtatctccaattgatgttagagctgtaaatcagcaaagcggtgcaacaagtcttgattatttcaaacatagagaagatgggatgcgtgtcattgctgttgggggaaatagtctttccagagggttgacattagagggattatgtgtcagttacttttatcgccgctcccttatgtatgatacattgctgcagatggggcgttggtttggataccgccctgattatgaagacttatttaaaatttggataagcgtagaggcaatagattggtatggatacataacaggggcttcagaagaactgaaacttgaaatcgcacggatgaagaacgctaaccttacaccaatggattttggcctcaaggttcggcaagatccagcctcattaatagttacagctagaaataagatgagattggcaacctttgtgaaacgacccataactgtttcaggacggttgcttgaaacgccgcgtttaagagctgatagagagtctcttaatacgaatgaggaagtttttaaggagtttgtcgagcgactgccagagataggtttacgtgtcgaacgtgatgacactcgttttttctggaatggtgtcagcaaagatgaaattgagcagctgctgcgtgattttaaaactcatccttggcagcttaatttccaaggtgcggcattggcagattttattaaaagtgatgtagatatgggagattgggatgtatttattgcagagggaagcgatgaagatacctatgagttgaagtgcggaaatgaacttttgcaaattaaccctgaaaaacgtgcggtcaaagcaacaaacagacaaatcagtattagcggtacaaaagttcgtgttggtgctggcggtgcagcaaaaatcggtttaactgaaaatgaaaagaaaatagcagaggataatttcagaattgtaaaaccaaatgcaagcagtatccctgataaagcctatttaaatatacagcgtaaaccaattctggtgttacatgttgttagtgttgataaggttaaaacagatgacaaaggaaagctccgcagccaaattgatgaaggggtagaggtacctgattatttatttgccctgggcattggaattccggcaattggggaggaaaaaacagcaaactatatggttaatttagttgaattccgcaattactataacatcgatgaagaggaggatgaatgaaattaacacctgaaaaccttcaaaagcagtgggatagcataaaatataaggatggcggttttttacagattgatacaatgcatccgctggagtggtatatcggttatcagtctgtaagccaaaaaacattgttactcgtaagtgatacagagatagatataattgaatcttcaaaatctatggcggtaaacagacgcagacgtgaggttgataatcgctggactctttcattcgagttgcttcgagacgagcagcaagatgtgtttgctatactttgctgtgacgttattgagtattccagagtagccataagtgaaaaagaggcattgacattagcaataagccgttacagacaatgggggaaattacttgagcagcagcgcggcggattaatgaacgagaatctgcaaaaaggattgcttggtgaattattatttttagaagagcgtatcaatttacaggattttgcattggatgctatacaaggatgggtgggggctgatggtgcggatcaagatttcgtgtattctgatgggtggtttgaggttaagtgtattggtgcatcagctattggcgtgactatctcttcattggagcagcttgattgttcggatgcgggagagttagtaattaagagagttgacaagacagctcctcaacggccaggtgctgtatctcttaatgatatagttcaccgtattagcggccggattgatggtgaagccttagatttattttatgccaagttatattcatatggatacatagatttgcaggaatactccgaacagaagtattattgctctgctacacaacggtacagagtagacgattcttttccgaggattacacgtaagatggcagcaaagcaaatagcatcattacgttatgagttaaatttgccttcgttggcaaagtggctaaaggagtgagataaatggatgcacaggagtttaagaaagacttccttgaagatataaaggcggatgcggccgcaactggcgagggctcctgtgcctcttttgtgactgcttttgcacggtatttgcaagaagctgattacctgttagattttacgtcttcctactttgaaggaattggaaagcaaaatcgaaaactgcgcgttgacggatatgtttatgatgagtttgataagactatgagtcttattgttgctgattatgatgttttggataatgaacgtgttcttgcaaaaacccaggctagacaattgcagaataggcttatctattttgttgataatgcccttaatacgcagttgcacagaaatgttgaaatgagccggtcctgctcggatttggtggatttacttcgggagaaaaggagtgagatacgcaaatatcagctgctgatttttacaacagctgatattagttctaccattaaaattcttgaatcgccggaaataaataatgttccgtcagaatgccaaatatggaatgtggagcgtctttttcagctgtgcggatcagatatagggcggcaagttattgaaattgatttcaaagagtacacagaaaatgggataccttgtttggaagcgagcgatacggtaacagaagattttaaaagttatctttgtattatatcaggaacagtgcttgctgatttgtatgataaatatggaagttcccttctggaaggaaatgtccgctcttttctttcaactaaagtagccgtaaataagaaaatccgaactactattctgcagcagccagagcgattttttgcatataataatggtatatcagcaacaaccatgggcgtgaaatttgaatctacatcacaaggattgttccttgtttctgcaagggattttcagattattaatggcggtcagactacggcatctttgtcaaatgcccgctatagggacaaagcagaccttaatacaatttttgttcaaatgaaactaactgatattgcgggaacgcttgagaatgaggatgcaacgacgctggtgcaaaatatatcacgttcgtctaatagtcaaaataaagtcagtgatgcagactttttctccacgcatccatttcatgttcaaatggaacgttgttcacagcggcttggagcaagaggaacgggagggctgcaattcgagacgaaatggttttatgagagagcacgggggcagtttcttcaaaaacaaatgcgcatgacgccaagccaaaagaagaaattcttgcttcaaaatccgaagaaccagcttattaccaaaactgatcttgccaaagtcagaaacacatgggatggattaccgcatatagtcagcaaaggtgcacagacaaattttaatgattttgcgaagaaaatcaatgatgcttgggagaaggatgacggtttgctttttggagataaatactttcaggaaaccgttgctatgtgcttgatttttaggtatactgaatcgatgataccgcatcaattgtggtatcagcagggatatagagctaatattgtaacgtatactattgcacttatgcacagacttattcagattaagtatcctaaacaagatttagatttgcttggcatttggacaagacaaatggttccggtgattgtacaaaatattcttaaagaattatcagaactcgtctatagcaaattaacagacccgacacgagaggttgaaaatgttacgcagtggtgtaaacgagagggatgctggaacagtgttcaaagtatcgattataatttaccgattgacatcgagagttgtttaattggaaaagatgagttgcggaacgctgtcagggatgcaaaggcagacatgcgtattgaaaaagatactgatgttatgacgagaattgtggaaatacaagcagaacaatggcaaaatgtgatgagttatgcaacgagtaaacgtatggtatccccagaggaattgacagcattgaaaattgcttgtcagcttcccctgaaagtacctaacccagtacagtgcaagaaacttattgctgtgctggatagattatatgaggagggattcaagctatgagaagcacgccaaaatctaaatatagtgttgttgatttatttgcaggtgcaggcgggcttagttatgggtttcttcaaactggacgatttgatgtcaaggccgcgtttgaaaataatcgtaatgcacaaaaaacatatcagcgcaatcatggtactgctgaggtttataatgatgttgcagatgctcttactgttgaaataaaagaaaagattggacaggtggatattgttattggaggtcccccatgccaaggtttttcaaatgctaaccgacaaaaaaaccatgcaataagtcagaataattcattggtgaagaaatttgtgcaggcagtattacatctaaatccgactgcttttgtaatggaaaatgtaagcatgctgaagtcagaggttcaccgtttttatgtagatgagaatgatagggaagttataaaaaagtataatattaaaacgacccctgcagaaatagtattgcttgatgaggcatttatgtttgatggagtagcagatattgtcgctgatgttgatgtgctaaataattatctttgggatgagaaggattatcttgtactgaatgtaatttataaaatgcgtaaaaataaggggaaactaaaagaatctttaataaagcataaaaagaaactgcagactttatctgaacgcatcttgctagaagaagatattgacgattatattttaaggcaagctaataatgcaggccaagctattcagcaatacttttcagcaacacacactgatgaaggagctgatggtttgtgtgaatctatagagataataataatgattcaaagaatgctgtccaaggcaaaggaaatttataataataaaattgtagtgtccgagtatgcgcatgaacgtaatcttgttgcaaaggttagttcaatgtcagtggttgactatatagagtcaatccttggtgcaccaagtagtggatatattatggacaaaggtgttctgtctgcagccgcttttggagcaccccaaaagcgtatgcgttttgttgttataggaataaaaaaggaaaaagctgataagattgatttgccaaaaggaatgttaggcgaggaagattttcagacagtgaaagatgctattaaagatttagaagatattgcaactacatcagatatagcaacgggaaataaaggcatacagctttcagaggaaccaaaggacataagtgacttagggcggcagttacgtgattcaaaggtattatataatcatgttacgaccgcaacaacaaataaagcacttgagcggttcagggccatcaagcaaggtgataattttcatagccttgaggcagagttgaaaacgagctattctgatccgacacgaactcaaaatacaatttatttaagattgaattacaacgagccttcggggacagtggtcaacgtgaggaagtctatgtggattcatcctgttaatgatcgagctttaagtattcgagaagcagcacgattacaaactttccctgatagttttgttttttgcggtacaaaggattcgcagtaccaacaagtgggtaatgctgtgccgccgattttagcaaaagctattgcagagcatttgtgcaaatatttggatggagaaaattaactattcgatgataataaattctgtaaaagtgttttttccaagcagataaaatccgcttttgattataaggggattggtgaaagtatatggcagataatcattcaaaagaaattagaagctataatatgtctcaaattcgcagtaagaacactaaaccggaagaaattgtacgaaaatatttgttttcaaaaggatttaggtatagaaaaaatgataaaagatatcctggacgaccagatatcatattgcctaaatataaaacagctatatttgtaaatgggtgtttttggcatatgcatgatggatgtcccaaatttataatgcccaaatcaaacatcgaatattggaaacctaaattggaacgtaataaacgccatgatatagaaaataaaattactttagaaaaacaagagtggaaggttatagttgtttgggagtgcgaattgaaaaaagataataaagaagatagattgaggcgtcttgttgaggaaattgtccaaaatatacctaacacgtaaacttgattttttattgaatggtaatatctattttatataaaaagtgttttccaaacctgttatttttcataaagaaaaatggctctttgttaatagttggggtgggatttggtaaaatcctgccccagccctatgatattggcactttttagagactatcccaaagattgtgtaactctccaaactgatgtaagatacaactacacagcttggagggtttattatggtaaggaaaaatgacacaccacagaaagccgctatgcgggagctgatgaagggctacttgaaacagaatgatgtgaaaatcaaaggcggtaccgatgtgaatgcaatcatgagggatacgatgccggctattctggaaggtgtcctggatgaggagctgaacgaggagctggactattctaaatacgtttaccgcaacaaggagactgaaaacagcaggaacggccattctcaaaagaccatgcatacaagctatgacgatatggaacttgatatccccagagaccggaccgaggattttgaaccacaagtcatcaggaaatatcaaaacatggtcacccaggatatggaggaaaaaatcatccccatgtatgcaaaagggatgactaccaatgacatcgagagtcatatgagggaaccctacgggattgacatccctgacagcaccacaagccgcatcaccgacaggatactacctatcgtaaaagagtggcaggaacgccccccctggatggtatctatgccgttgtgtttttggatgcggtccattaccgtgtccgcagcgagggacgcatggtaaggcaggctgtctatatcgccatagggattgcatgaatgacaggaaagacgtccttgccatgtacgtgggacagaataaaagtgcaaggttctgtctgtccatcctgagcggattgaaaaaccgtggtgtaaaggatatcctgatagtatgcgtggacggcctgacaggatttcctcaggctattgaagcggtataccctcaaacagagattcagcagagcatcatccatcagattcggaacactacgtaatttgtatcctacaaagaaatcaagccactgatgtctgatttaaagcgggtatatgctgcaccaacagaggacgccgcattgggtgcgctgaaagacttcggggaaaataggatagaagatatcccaggatatcaaagtcctgtaaggaggactgggctaacctgtcaacgtacttcaaatatccagaaatggtaagactcctgatttacacgaccaaaatagaggggttcaattgctagctgcggaaagtaacaaagtcaaagacggtatttccctcaaataacagcctgataaaaatgctatatctggtgatgatggatatcacgaagaaatagaccggccactgtcagtactgggggcagattcattggcaactggagatatattttgaggagagtttatcctgattataagctgaaaggggctaccgaggcagttttcctgacatgacctaaaccagccttatgatacaaacaaagggcaggatttaaaaaacggcattgctctttggaaacgattgacatatcttatatcagtttcttgagtttacacaaaacttgaaacggtctcacttttatgtataattccaagttttactgattttgggtatattaaataagccttcgcatgaccgaccattttatcctatgatgtacagggagtatccggattcgaaaacgcttgaagttcctgataccgttgctactccgttattcatacctttgtcttgctgctaaatccttctgtgggactatttgttagcccgtatttaaaggaatccagtatagaaccagaaaaatcccccattgccccctgtttccggcatccatcggggccatggcatcagtctatatgctgttaaaaaattaaggagaagagcgaaaaaggccgataacccgcgaaaatgacatagctttccctgcatttacaattcttaaggtcattctatttctcaaaatcatcccaatcagcctatggcctggatgttttatcacagcctttggtctttccaacccctttatcctccgctttgtcatgggctgtccgtccgccggcctgtgtaccggccataccggctttttccgcctccgccttcagcgcttccatatccactggttcggaaggctttaagacacgtgtcatcagtcccatggcaaacatgatgatgggtatgaacaccatggagaaaatcacggccatcaggtaattctttggggcgcctgtcacggccaggataatggccagtacaaacagcgccacaagaagcaaggctccggccagggccaggatccgttttaatttcatacattgactcctttcatccgcttattgttttttatccgttctgaccatcggttctggttatccgttctggccaccggtcctggccatcaggcccaaaccatccgttccaaccatccgctcagaaaccatcaatcctcagccagttcttcccatcgctcatacagttcttccagctgccgggcaatttcttccttttccctgttcagttccatcagcctgtccacatcggtgtagacctcttccagggaaagcagcccgtcaatctcactgtccctggtttccagggcatggatggaatcctctgttttcttcagttcgttctgtcgcttgcgtatgcgcgcctgttcttccttccgggccttccagtccagctttatatcgctggcagaagaggaggccagatccctgtccggcgttccagcaggcgcctggcccgcagcattccttgctgcgaatgctgcttccacgtcatccttcttctcaaggtaataatcgtagttgccgatataattaatcagggactggctggtcaggtccagtatcctggtggcggtgcggttgatgaaataacggtcatgggacacataaagcacggtgcccgtatagcggcagagggcgctttccagtatctccttggacgtgatgtccagatggttggtaggctcgtccagtaaaaggaagttggcgtcggagagcatgagcttggccagggacacgcgtccgcgttccccgccgcttaagtcccggatcagcttgaacacatcatcgcccgtgaacaggaaggaggccagggtattgcggatctgggtattattcatgtcaggataggtatcctgtatctcctcaaacaatgtcttgtccatgtgcaggacctggtgttcctggtcgtaataaccgatgtgcaccttggaacccaggcggatttcgccgctgtcagcctccaggaggccgttgatgatttttaacagggtggtcttgccggttccgttgttgcctatgatagccacccgttccccgcgtttgatatcaaaatccacgtgggaaaaaagggtctgggcgtcaaaggatttgcttaattccctgaccgtcagcacatcattgccgctgattacatccggctccagccgtatatccatggaatcgtcaatttccaccggtttatccagccgctcaatcttatccagcatcttttcacggctctcggcacgccggatggacttttcacggttaaaggatttaagcttggtgatgactgcttcctggtgtttgatttcctgctgctggtttagatatgccctgattttggcatcccggagcatggctttcttgtcgctgtaggcggaataattgcctgagaacatggtcccgatgccgttatccagctccacaatcttggaaaccacacggtccaggaaataacggtcatgggcaacgatgatcacgctgcctgaataacccttcaaataggtttccagccaggcaatggactccatgtccaggtggttggtcggctcgtcaagcagcagtacgtccggcttggtgagcaggagcttgcccagggagacacgggttttctggccgccggaaagggtgttgatgggcttggtaaattcgtcctcgctgaatccaaggccttttaatacgcccgtgacctcgcttttataagcatagccattggccagttcaaaggcatggtttaagcggctgtattccgccagcatggcttccagggcatcgcctgaggcggaatgcatcttaagctccaggctgcggatccgctcctccatctgtatgaccgggcgctttacctccagaagggcttcgtaaatcgtgctttcgctgtccaggtcctggtgctgcgccagataacctatggtggagcccttgctgagggccacaacgccctcgtctgcagccagctcgccgatgatgattttcagaagggtggtcttgcctgcaccgttaatgcccacgatggccgccttttcgtggtcttccaggtggaaggaaacctgctttaagatatgtttgtcaccgaaggacttggttatattgctgcatgataaaatcatggttaaactcctttgcattgtacaccggcgccccatccgggcggggaaccggggcgctgtctttacgcgcttatatgggaaggaaacccgcatataccgcctgtttttcaaggctccagaccgccgggatttccatattatactttcaccagtataatataataggaaaattttttcaagaacatactgaaacgtgtttgacatttttttgacacttgtttataatagaaccattaggtatttatagaaacgcgtaaggggaaggtggaacacaatggaacgcaaagagatatcaaaggcggtaatttcaagattgccccgctattaccgctacctgggtgaactgattgaggagggtgtggaacgcatctcttccaatgagcttagcgccaggatgaaagtaacggcatcacagatccgtcaggaccttaataattttggaggattcggccagcagggatacggttataacgtcaagtacctgtatgccgagatagcaaagattttaggaattgaccagcagcacaacctgatcatcatcggggctggcaatctggggcaggccattgcaaactatacgaatttcgaaaggcgtggatttgtcatcaagggcatgtttgacattaaccccaagctgattggcctggtaatccgcgggattgagatccgctccgtggatgatctggagcactacatcaaggagaatgagattcagatagcggccctgaccattccaaagacaaaggcgcctgagattgcagaccgtcttgtccaggccggtatcaaggcaatctggaactttgcccataccgatctggtggttccggatgatgtggtagtggagaatgtccatctgtctgaaagtctgatgcgcctatcatacagggtatgcagcatgtacgaccagaagacggaagagggaaaagcatcaaagtaagaatcagccggcaagcaaaggagccattctttatgcttgccggcctttgctttttacaggaggtaaatgcggatgagaacactggtaacggcaaaacagatgaaggcggtggacgcccataccatccataccataggcataccgtccatggtcctgatggaacgggcggccctttgggtggcagaagaggcagaggccctggccggacagagggatgctgtctgggcggtgtgcggcaccggtaacaacggggcggacggcgtggcggcggccaggatgctttatctgaaaggatatcaggcttgtatttacgtggtggggaacctggaaaaggggacagaggagtttaaggcccaggtatccattgcgcgcaggctgggcatggaggtcaggccctggaccggggcagcggatggggagtgcagccttctcattgacgcggtattcggcgtgggcttaagccgtcccatcgagggggagtacagacagtgcatggaaatgctgtctggaaagaggattccccataccatcgcggtggatgttccctcgggaatccatggggacacgggggctgtcatgggcattgcgctgaaggcggatgtcactgtcacctttggctgggagaagaccggaacagccctttatccgggcagggaatacgcgggcagggtaaaggtatgcgatatcggattcccggaaacagcccttggggccgtggcggaggcagaggaagggtgtggatacgccttcacctacgggccggaggatctggctcttattccaggccggcccgcctattccaataagggaacctttgggaaggtgctgattgcagcagggtcgcggaacatgtgcggcgccgcatacctcagcgccctggctgcctaccgcaccggcgccgggctggttaagctcctgaccgtggaggaaaaccgccagatccttcaggagcgcctgccggaagccatcatcgtcacctacacggcggaccagctggtttcgggcagggaagagtttaagcgcatgattgaggagcagatgaactgggcggatgtggtggtgctggggccgggacttggcagcgaaccatatgtggaatacctggtggaggatatactgaccagcgcctttgtgcctgtgatcattgatgcggacggcctcaatgccatagccgggcatccgtatctgaccacctactacacggaaaacatcataatcaccccccatcttggggagatggccaggctgacaggggagggcattgatgccatcaaggagaatctggccggggcagcgctggaatatgcggggcggtacggcattacctgcgtgcttaaggatgctgccacggtggcggcaggcaaggacgggacgctctacattaattccagcggcaacagcgccatggccaaggccggttccggcgatgtccttacgggtatcatcgcaggcctcgcggccattggcatggaggaagaacaggccgccctgatgggggtctaccttcacggcagggcaggagatgcggcagccaggcagacagggcagcacagccttctggcatcggatctggcacatgcaatcgggagggctatggagcccgcgatggaatgagacaaaacaggaggcagataaaatgaaaccatacagcagggtatatgcggccatccatctggatgcggtggctgccaatatggaggccatgaaggcaaacctcccggcttccacgtccatgatcggcgtggtcaagacagacggttacggacatggcgcagtgccggttgccaggaccattgacccgtatgtggacggatatgccgtggcatccgtggacgaaggcatgatcctgcgccgccacggcatacgcaagatgatccttgtcctgggcgtgacccatgaaagccggtttgaggacctggttcagtacgatatccgtccggccatgttccggtacggggaggcccaaaagctgtcggctgttgcagccgccatggggaagaaggccaatatccatctggcagtggacacgggcatgaaccgcatcggcatgaaaccggaccaggaatccgctgacatggtatacaggatcaacatgctggagggaatccgcattgagggcatgttcacacattttgcaagggcagacgaggcggataagaccacctatggactgcagtttgggaaatataatgattttgtggaaatgctcggcagcagagggataaccatcccaatcaggcattgctccaacagcgccggtatcgtggagtcgctgggggccaacggccttgacatggtgcgggcgggcatttccatctatggcctgtatccgtcggatgaggtgggaaaggatgcggtgaagctgacgccggccatggagcttaagagcttcatcacctacataaagaccattgaacccggggatgcggtgagctacggaggcacctttgtggctgacaggcagatgcgcgtggccaccatcccggtgggatacggggacggctatccgcgctccctttccggcctcggttctgtcctgatccgcggccagagggccaggatactgggccggatctgcatggaccagttcatggtggatgtgaccgggattgcgggtgcggcggaagacgacgaggtgacactgatcggaagggacggggatggattcatttccgtggaggaactggccggggccggaggcggtttccactatgaaatcatctgcggcatcgggaaacgggtgcccagggtatatatacggcacggcagggtgattgggaaaaaagattattttaatgatatttacgaaggcttcggatatatgtaaaagcctaccatgctccaaataagcgtctgaaacatatgatactattaggttacagggcaatgtatacacaggtcagatattgccaatactaaggttgaataaattgacggagtgtggacgatgtgattatcagacgtggagacatttattatgcggatttacggcctgtggtgggctccgagcagggaggggtccgtcctgtgctgatcatccagaatgacgtgggcaacaaacacagccccacggtcatatgcgcagccattacatcaaggatgaacaaagcaaagctgccgacccatgtggaactgaatacaaggcggtgtgccatgatcaaggactccgtcatccttttggagcagctgcgcaccattgacaagcagcggctgaaggaaaagatatgccatatagacgaggagcttcagcagaaggtggatgaagcgctgatggtaagcctggaactgcatacataggcacaggcaccattgacgaaatataagaaaaatgttatgataagcagagttatgccgtgatttaaggggcgttgctctgctttttacatgacaaaaagcagggcggcatgagtacgaaaggagtctttatagtattatggacgatggttattcgcctgtcagtatacttgtattgattggttttatccttctggaggctgtgttttatggattcggttcggcgattcagaacgtgaatgaagggaagctggaagatgaggcacgccaggggaacaggaaggctgccaggcttcttgagattgtcaaccggccggggcggttcgtgcacaccattcagatcacaacccatctgattggtatgattacaggcgcggtcatacttcctgtgctggtcaacgggctgatgaggcgcatccatatctttaagcccatggctggatggtatgacggggcatccagggtcccatggtacctggattccatgtggtgggagcagatcctgttcatggtggccgtggccatcgtgctgctgcttatcatcatcagcttcggaatcatcatccccaaacgtctggctgccaaggaaccggagaagtggggataccatatgctgcccgtggtcctgtttgccgcaggtgtgttcctgcccctgaccaggctgatcacactggtgtcagcccttgtactccggcttttcggggtggatatagcggacgatgacgacaatgtgacggaagaagacatcatgtccatggtaaatgaaggccatgagcagggagtcctggaagcagacgagacagagatgataaccaatatttttgaactgggggacaaggaagcttccgatatcatgacccaccgtaccaacatgacggccctggacggctccatgctgctgggggatgcggtgcattttatcttaaatgaaggcatcaacacccgttaccctgtgtaccgggaggatatagacgacattgtggggatcctgcatatgagggacgccatggtgtatgtggaaatggaagaatataaggacaggcctttgcttgaggtcccgggacttctcagggaagccaacttcatacctgagacgcggagcatcgacaccctgtttaaggagatgcagtccggcaagatccacatggaaatcgtggtggatgaatacggacagacggcaggactcctgaccatggaggacatactggaggaaatcgtaggaaacatcatggatgagtatgatgaggaagaggatttcatttccgtcagggaggacggctcctttatcatgagcggccttacgcccctggatgatgtgatggatgtactggatatcgagttcccggaggaggacagcgatacatatgataccctgaacggatatctgatatcgcgtctggaccgcataccccaggagggggagaatccccgggtggggttcggcggctatacctttgaggtaatcaaggccggcaataagatgatagagagcatccacgtgtttaaggaccaggaggaggaaggggacagcgggaaggacagggaaggcctgcggacagaacaggggaaggacagcggcaatccccaatcagataaatccaaaaaaggcttggtggaaggaaaagatgacaggaatcatagagagcacgaaggaaatgttccgtgacagcaggtttttaagaaaggcccttatgattgcctgcccggtagcgcttcagggcatgttgaacacagtggtgaaccttgtggacacattgatgattggcaccctgggggcaacggccattgcggccgtggggctggcgaataaggtcttttttgtgttttccctgctggtattcgggattgtcagcggcgcagggatcctggccgcccaattctggggaagcggggatgtaaagaatatcaggaaggtcctggggctgtccatcctgcttgcactgggaggcgccctgttttttgcggtacccgcaatcctatgtccacaggcggtgatgcgtatcttcaccaccagccaggacagcatagagcttggggcaaagtatctgaagatagcggccctcacctatcccttcattgcgttgaccaatgtgtatgtggccatgctgagggcggtaaaccgggtggtgttcccggtcattggcagctgtatcgccattgcgattaatatctgccttaactatgtgctgattttcggcaagttcggcgccccggccctgggtgtggcgggcgcggccctggcaaccctcatcgcgcgtgtgattgaggtatgtctcatgcttacctatgtttacaccaggaaaatgcccattgcctgcggcttttcagggcttttcggatggccgtccgcatttgtgaaggcatttgcgctcacatccgtccctgtcattgccaacgagttcatgtggggccttggcaccaccatgtattccctggcttacggccggatgggggacgaggcggtggcggccataaccattgccaccaccatacaggatattgtggtggtgctgttccagggactcagcgcagccaccgcggtcatcctgggcaatgagctgggggcgggcaagataaagcgggccgagaaatacgccacccagttcttcatcctgcagttcattgtcaccattgcatcggcctttgtggtaatcgggatcagaggcccgcttatcgggctttataacatcacggaagcagttggccatgatgtgaacatgtgcatcctgatatttgcctgctatatgccggccaagatgttcaactatgtgaatgtggtgggtgtgttaagaagcgggggcgacacgaagatgtgcctgttcctggataccagcggggtctggttcatcggtgtgcccctggcgttcttaggcgcccttgtgtggcatctgcccatctatatggtctatggcctggtcatgctggaggaagtctataaggccgtgctgggttatatccgttacaggcagaagaagtggctgaggaacctgaccacgcaggtgcagcagggataggcggaccggtaaggcgtgcaggattttttacttgccatataaaaaaaatcgtgctaagatagaaaagatgtgtataaaatacagcataagctgtatgaagtatagaaaaacagattaagcagaataaaggaaagggtgttttatcgatgtcaggacattcaaagtttgccaatattaaacataagaaggagcgcaatgacgcggcaaagggcaaggttttcactgtaatcggacgtgagattgcggtggctgtaaaggaaggcggcgcggatccggccaacaacagcaagctgcgcgacgtaattgccaaggcaaaagccaataacatgccgaatgataccattgaccgcggcattaagaaagcagcaggcgatgctgcatccgtgaactacgagatccttacatatgaaggatacgggccaagcggggtagccattatcgtcgacacgctgacggataacaagaaccgcacggctgctaatgtgagaagtgcatttaccaagggcggcggcaacgtagggacccctggaagcgtgtcttacatgttcgacaagaagggccagatcatcattgacaaggaagaatgtgagatggatccggatgagctgatgatgattgccctggatgcaggcgcagaggactttgccgaggaagaggacagctacgaggtcatcactgccccggaggatttcagcgctgtgcgtgaggccctggaggcccaggatattcccatgatggaagcggatgtgaccatgattccccagacctgggtggagctgaccgatgaggaggatatcaagaagctgaacaagaccctggacctgctggatgaggatgatgacgtccaggccgtgtaccataactgggatgagtaatgcattaccattaggaacatatattgaagaaatgacagaaggaccggtcatgtggctgaatcatcagccgcatccggtcctttttatgttttagttggagaccaccatggtgcgcagcccgtcggttgcattgggggcattgaaaatatacagggtgtaggaattgttggcgctcatattggcggcggcagttgccagataggtggatgggaatgcgccggtcctggcaatatagagctgataccatcccggataaaagctggtatacggcgtcacttcccggtagcgtacattggtaaaggccacgtaggaattgttctggttcccaatggacacgtcgaaaggcccaaggttctgtgacaggttgcaggtgcgcaggcagctggtgccggaaggcgcgttgcaggaaatgtcggagatttccatgatgtccaggccgcttgccgtgttgatgatggcaatggtcatggaggaggaagcccttacctggaccggtttctggatgtagacatatccgttggcgccggacacggtaatggtctgcgtacctgaggctgcctgcacatagcttgtgatgtccccgtttgcaagcccgcttgccaccatccagttgccgatgtacacatagaatggctggtaacccgtggacgcattgaggatgcgcaccctgccaaagctggtggcggtgcagttgtagcatgggaaggtgatgccgggaatgacggtgacggaaccgcctgtgccgcctgggaatacgggacggaaaataggcgggaagtttggacgtccgctgtccacaggaccgccctcgcctgggttgggaagggggatgacagggacgccggcgccattgtccatgttgttcccgctgtccacaggaccgccttcgcctggattgggaagaggggtaatgggcatatccgcctcactgacctcggcggcgctgaccaacgtgtccggatacccatttgctctgtccatatgataggattggttattcataacgacctcactgattgattgattcagtatagtctattcaggtgcagggccaaatgtgagtgatttttcaaaaaaacatctatgtcacggaaatacccgggatggttgaaatggaactgcattttccacccatttatgcatataataaaaagaaccagtgtatcaggagcgtggatcgtatgtcatgggaaccaaagaaaacagctgtgtctgcactgggtctgccccgggacgtgatcctgggcgatgtgcttgtaagctttgtgggccgcggacaggtgaatgtggaaaattacaggagcatccttatatatacagataccctggtaaaacttcaggcgaaaaactgtaaggtactcatccacggaaaccgtttgagaattgattattatacatctgaggagatgaagataaccggtcagattggttcgctggaattcgaaacataagtgggcggctgcccgtaagcgtctgagggacggacgctaaatgctcatagcgaggaggggcctgtttgattgtttggctgttacataactggaaaggatatgtaagactccgtcttcacggttattcgccggaacgtttcctcaacctgtgcaatgccagggggctggaagtctgggggcttatatgcaaccgggacggggactatgaattttatatgacagtggaagggtaccgccgtgtaaagcccctggtacgcaaagcccaggtaaggctgcatatcatcgggcgttttggtattcccttttttatttacagatacagaaaacgctggtatttcggggctggcctggctgcatttttcctggtgctgtatgtgatgtccctgttcatatgggatatccagtttgacggcaattaccggtatacctacgacaccctcatacgttacctggattcccaggacattgattatgggatgcttaaatccaggattaactgtgaggacctggaagcgtccatccgcaccagctttccggagattacctgggtgtcggccagggtatcgggcaccaggctcctgatccatatcaaggaaaatgaagtgctgtccattgtccctgagaaggacgagacaccctgtgacattgtggctgaccgggcgggtaccatcacatccatggtggtgcgccaggggattgcccaggtttccgttggggatgaggtggaggaaggacaggtactggtcagcggccgcgtgcccattatcggtgacagcgaggaggaaatcaatgcctatctggtccatgcggacgcggatgtggtggccaggacatccagggagtatgaaaagacatttcccatgctccacagggaacgggcagggacagggcgcaggcgcaggggatggtatgtgaaggcgggcagatggtccttcacctgcctgcttccggtcaggggacagggggaatgggattatgccatggaagagcagcagctgaggctgttttccaatttttacctgcctgtctacataggggatataaggggaaaggaaatggtttcctatgaaagcaattatacaaaggaggaactggaacacatatcaaaagccataaattaccaatttgtcaaaaatttagaggaaaagggggtacaaattcttgaaaataatgatagaatagaaacaagtgtatctgaatgcaggctgaagggggagttagtgacccaggaatccatcgtaaggacccagcccatgtcagaacccatgacggaaccggatacacagccaactacagagccagaggagacgagataagcttagatgagtgtgattgagaccatgattgacatccccgctgaacatgagaagaatgtctgcgggcagtttgacacataccttaagaagatagagcgcaccctgcatgtgaccatgattgccagggacggcgagattaagatcatagggccggaacagaccataggccaggccaggagcgtgttcaacaacctgattgaactgtccaaaaggggcaataccattacggagcagaacgtggactatgccctgtccctttcctttacggagaaggacggccaaatcctggagattgacaaggacattatctgcaggaccattaccggcaagccggtaaagcccaagaccctgggacagaagaattatgtggatgccatccgcaagaagatgattgtgttcggcatcggaccggccggtaccggtaagacctacctggccatggccatggccatccaggcctttaagaacggggaagtggggcgtatcatcctgacgcgtcctgccatagaggcaggggagaagctgggattcctgccaggggaccttcagagcaagattgacccgtatctaaggcctttatatgatgccttgtatcagattatgggtgctgagtcgtacctgcataactctgagaaggggctgattgaggtggcgcccctggcgtacatgaggggacgtacactggacaatgcctacatcatactggatgaggcccagaacaccacgcctgcccagatgaagatgttccttacaaggatcggttttggttctaaggtcatcattaccggcgaccagacccagaaggaccttccctcgggagccgtatccggcctggacacggcccttaaggtgctgaggaagatagacgatatcggattctgttacctgaccagttctgacgtggtgcgtcatccgctggtacagaaaatcgtacaggcatatgaatcctatgaacagaagaatacgccgcctgtaaagcgtgagcgccgcagggagaggtaggcaggaaaagccggagagaggttacccatgacaatatccattgaatacgaagcagaaaaaaaactggacctgccctacggggatatcatccgtgatatcgtcctggcggccctggattatgaggaatgcccttatgaggcagaggtgaatgtaatccttacggataatgaggccatccgggaaatcaaccgggagtaccgggagattgactcacccacggacgtgctctcattccccatggtggattacgttgcgccctcggattttgaccatgtggaggaggctgtggaggattattttaatcctgagaccggggaactgatgctgggcgatattgtggtttccgtggacaaggtggaggaacaggcggaaaagtatggccattctgagacacgtgagctggcatttctggtggcgcacagcatgctgcatctgtttggctacgaccatatggaggaaggggagcgggaacagatggaggacaggcagaggaagattctggaaaccagggggtacacaagatgaagaaaaggctcagatggatggcagtgatgacggcggcagcctgctttatggccggatgtgccagggaggcaggcgtggacgttgcaagtacgcctggggtggagacgcctgccgtgaccactgagcctgaaatcatcatacattctgaacgtgaaacagacggcgtggagccggatggggcgggggattactatctcccggaggaacgggaagaaaaggacggcatgatacgcagctacctgaccgggaaaatggttcctgtgtctcagggaaaccggcggcccgcagccgtcatgatgagcaacgacaaggaggcccgtccccagtatggcatcaaccgggccggggtggtctatgaggccccagtggagggcgggatgaaccgctatatgtcgctgattgaggattatgatgacctggagcggattggttccgtgcgcagctgccggacttactatacgtattttgccagggaatttgatgctgtctatgtacatttcgggcagagcacatttgccaaaccttatctgaacaatgtggacaatatcaacggcctggaagggatagggaccactgcattctaccgcacaaaggataaaaagtccccacacaacgcatataccagcggccagcgtatcacggagtccattcagaagttaggctatgctcctgattatgatgcctcctataagggccattacctctttgccagggatgggaaggaagcgtcattggaaggccgtcccggggtcatggacgcgggcacggtaaagccggggtatgccatgaatcaggcgtattttgtatacgattcctcggatgggctgtatcaccggtatcagtacggcggtgtgcaccagggggatgaaggccccgtcacggctaggaacgtgatattccagtattgccagtccggcttttatgccaccacggattatctgaatattaatgtacatacctctgactgcgggtattttatgacaggcggcaaggcgattcccatcagctgggaaaaggatggggagtttggcgttacccggtattatgaccaggaacacaacgaagtggtgctgaaccagggacagacatggatctgcatcatttccaccaaggattttgccaagtcagaaataattgggaaatgaggactcacaataaagagatatgaatgtaagcacatctaagaaaagaaccagaaaacaaaaggctgccaacttcgtcatacagggcagcatcctggcaatggccggtatcctggtacgcatcatcggcatgctgtaccggatgccccttaacgacatcataggaaaacagggcaatggatattatacatcggccttcaatgtgtataatatcctgttaatattatcctcctacagcatgccggtggcggtatccaagatgatatccgccaggattgccaggggggagtacagaaactgcagccgcatcctgaaggcggctcttatttatgccaccgtgattgggggcgtggcagctgttgtgctgtggtttggggcggatgcatttgcggatttaattaagatgccctccagccgttatgcgcttaagactttggtacctactatttggattatggcttatttgggggtgctcaggggatacttccagggaacgggaaccatggtgcctacagcaatatcccagatcctggagcagattgtcaatgctgtggtaagtgtggttgcagccgggcttctgtttaatgttggggcctctatgaatgcggcacaaggggctaaggattactcctatgccttgggggcggcaggcggtacgataggtactggggcgggagcgctgacagctcttgtctattttattatccttacactttcaaagggaagggatatgaggacgcggaccagggaagatgtgtcgggcagagttgaaagttaccggcatttggttaggatactgaccattacggttctgcccatcgtaatcagcagcggaatctataattgttctaacgtggtggataactatctctttgggcaggggatgtctaaattgggatatatggaggatgcaattgccaccagcctgggtgctttgggccaataccagattctgtttaatattccagtagcggtgtctaatgccctgtcaacctccctgataccttctcttaccagggcggtggagtgcagaaagagaaaggaaaagctggagcgcattgcggcatcaatccgtttctcacttctcgttgccattcccgccgcagtggggattacggtgctggccaaaccggtatgtaacctactgtttgccagcgaggataataccatgctgattcgtctttccatggtgggatccctggccgtggtattttattccctgtccacggtgaccaatgccatcctacagggactgaaccgtttggatgtgcctatccgccatgcgatggtagcgctagttatccatgtggcggtgctggaggtattcctgatggtgttcaagataggaatctacagcgtcgtctttgccaatattgtctttgcccttgtgatgtgcctgctgaacggacatgccattgcacgatttgtgagataccggcaggagtacaaaaagacggtgttcctacccacattgtgttcgattatcatgggcgcagcggcctatggggtgtaccgcggcgtatatgccctgcttccgtcctccatgttgcgcggaaggcttggcatggcaattgttgtgatgccatccgtagccgtggccgttatcgtatatgcgttgcttctagtaaaactgaaggcggtgggcgaagaggaactgaaggggatgccggggggccgccggcttgtaatgctgttaggccgtctgcatcttatatagggactgtctgaaaatggtttcccgtgatttgtgcgtctgggtactgaatccctcattgtccggctaaataacaggaaaaatttgtgaaaacatgattaaaacagcatagaaagcagatactaacctcagagcgtgttccagagcatgtctgagaaatgctccagcatgttaggaggttagcctgatgaaaaaagtattatactgtgtcctgctgtttattgccacatcgattgtatgccttatcgtgggttatggggttaccagatataatgtgagacaggagcaggcggttcccaatacggtgattgagactgagactgtcaatgatatggatgacaaggcagccatgaaccaggaacagataaagcccatcctggagagccagtccccggcagaggagtactacctggtggctgagtccggtttcctgctggtattctgcagcgacagaagtacaatctgcctttacacccatattccggtgacggattttccggagaaggagaggtccaggctcatggagggaatctggttcccttccatgatggatgtgtatcactacctggagtcgttcaccagctgaacggggatgggtttctgctttgatgcaggaatccaccccgtcttttatgttacatggatacataaggcgctgaccgggaatccggataaaatccccggctttccatccattccttttctaatggattatttagtagttgaaatatgacagaaaagcggataaaatgagttgtaaacttttatcggacagtaaggagcctgacatagatatggaaaaaagggttgtgattataggcggcggcgcatccgggctggtggcggccattgaggcggccagacggggcgcccgtgtgacggttgtggaacatatggaccgggtggggaagaagatactctccacgggcaatggaagatgtaacatgacaaacctttacatggagccggaatgctaccgcagcggcgacgggagctttcccatgaaggtcataagcggtttttcggtggaggataccctgcgctttttcagggggctggggattgaaaccagggacaggaacggatatatctatcccaattccgaccaggcatccgctgtgctggatgtcctgcgccaggaattggggcaccttggcgtacaggtgcttctctcctgtgaggcggaccggatagagcagcttcatgacggcacatataggatttcgtccagccaggggatgctggaggcggatgccctgattctggctgctgggtctaaggccgcgccctccaccggctctgacggcagcgggtatgaactggccaaacgcctgggacaccgtgtgataaagccgcttccggccctggtgcagctcagatgccaggggaacatgtataagcagatggcaggtatccgcaccgaagcaagggtgggcctgtacatggaaagtccccgattcagtaaatcggggaaaggtgcagaaagtccccgattagataaatcggggaaaggagtggaaaatccccagtccaataaatcggggaaaggtgcaggcaggatccttctggcagaggataaaggagagctgcagctgacggattacggtctgtcagggattcccgtgttccaggtcagccgttttgcggccagggcattggatgagggcaggagggtggttgtgaaggtggatttcatgccgtcctggaaggaagaggaggcattgggccttttgaggaaacgcgcggcccgcatggattataagacagtggaggaaatgttcaccggtcttctgaataagaaactggccctggtcctgattcggctggcaggggtggacccttccatgaaatcgggggaattatccgccaggcaggcaggccgccttctggaacagattaaatcctatgaggccattgtcatgtccgtgaacccctttgccaatgcgcaggtctgctgcggaggcgtggatgtgcatgaggtggacgggacaaccatggaatccaaggtcaaaaagggcctatacctggcaggggaactgctggacgtggacggtatctgcggcggctataacctgcagtttgcatggtccagcggggccatagctgggagaagtgccgcaggggaaagaaaaaacatggcagggaagaagcctgcgggaaggagccgctgatgatccgcataaaccagattaagcttccgctgggacatgacaggcaggacatgcttgcaaaggtttcctcggtcctgggggtgccggcaggggaaatccatacattggacatcatgaagcagtccgtggacgcaaggaagaagccggatatttcctacagctattcggtggatgtgacggtgaggggcattgccgggaaaaaggaagaaaagctggtgaaccggctgaggaaccggaatgtgctggtacaggacggcgggggatactgcctgcccaggccgggtacagcaggcctttcccatccgcccgtcatcatcggtacaggtcccgcagggctgttctgcgggcttttgctggcaaggcagggctaccgcccaatcctcctggaacggggcgaggacgtggataccaggacaaagcgggtggctgggttctgggaaaccggaaagctgtgccctgattccaatgtgcagttcggggaaggcggggcagggacattttcagatggaaagctgaataccctggtaaaggatgcgtcgggaaggaacagggaagtgctccggcttcttgtggagtttggggccgacccatccatcctgtatgtgaataagccgcacatcggcacggatgtgctgagccggatcgtaaaggccatgggcagggagatagcggacctgggaggacaggtgcggttctcaagccgggtcactgatttcatcgtggaacagggacgccttaaggcggtgatggtcaatggaagcgaacggattgacacggaggccctggtgcctgcgatcgggcacagcgccagggatacctttgaggtccttctggaccgggggattcccatggaggccaaggcgtttgcagtgggactgcgggtacagcacccgcagaagctcatcaaccagagccagtacggcatggaagagtgcagggagctggggcctgcaagttataaggtgacaaggcagaccgcagaaggcaggggcgtgtattccttctgcatgtgtccgggcggatatgttgtcaatgcatcctcggaaccgggacgtcttgcagtcaacggcatgagctaccatgacagggccggggacaatgccaacagcgcccttatcgtaacggtcaccccggaggatttccccgtggcggaggcgggaagggaggcccttgcaggggttgcgttccagcggaaactggaggaggacgcctttggcctgggaggcgggatgattcctgtccagctctacggggattttaaggaaaacaggatatccgcttcgtttggggaagtgaagccagcctttaaggggcagtactgttttgctaatttaagggaaatgctcccggaatccattaccaaggccctgttggagggaatggagggcttcgggcatatgataaaaggctttgaccgcccggacgccatatttgcgggaattgagagcaggacctcgtccccggtgcgcattcccagggatggaaacctggaaagcggagtcaggggaatctttccctgcggcgagggcgcgggttatgcgggaggcattacctcggcggccatggacggtatccggattgcggaggaaatcatccgcaggtacaggccgtttacagattcttaacaatgtgtgaagaccgcgataaaatcaatggtggaaaggaatagaaattgacgtgacctgtaaattggtgtaagataaacaggaatcaatataagaatcataaggagcataccatggaaatccaggaacgccaaagccttaaggaaaagcagaggattgtgattaagatcggttcctcctccctgacccatccgcagacaggggagatgaaccttatgaagatagagaagctgatacgggtcatcagtgacctgcgtggggagggacgggacgtggtcctggtgtcctcaggagccatcgcggcagggcgccaggccctgggacaccacaggcgtccggataccctggctgagaagcaggcatttgcagcagtggggcaggcccgcctcatgatggtctaccagaagctgtttgcggagtataaccagacagcggcccagatccttctcacaaaagataccatgatcaatgattcatccaggtacaatgcccagaacacctttgatgagcttttgaatctgggagccattcccattgtcaatgaaaatgataccgtgtccacctcggagattccctatgtggacagctttggggataatgacagactgtcagccatcgtggcggcgctgattggggcagaccttttaatcctgctttccgatatcgacggcctgtattccgatgatcccagaagtaatcctgaggcgcggtttgtaagcctggtgccggagattaccccggaattcctgaacatgggcaagtccacctccagcagcgatgtgggcacgggcggcatgtcggccaagctggcggcggccaggattgccacggacagcggggcggacatggtgattgccaacggcgaccaggtggaggtcatcctggatatcatggcgggtcaggaaaagggcaccttgttcttagcccatcccaacctggattttgatttgatgcattatctgaacaatgaatattaaaagaggtgattgacatggacgcatccagaattgaccgcatcaacgaattgtaccataagtcccagtccgtggggcttacggatgaggaaaaggaagagcaggcaaggctgcggcgggaatacattgccgccatacgcgggagcctgagaagcaacctgaataacatttccatacaggaacaggatggttccgtcacggatctgggtaagaagtacggcgggattaaggaagtttagagggttttccgccatgtgcagaagggagaggagagcaggatgacattaactgagatgggcagacgtgccaaggatgtatcaagggtacttaacaccctgggttccagggagaagaatatgggtcttgaggaagctgccagggctcttttggacagcgaggaggaaatcctcgcaggcaacagggaagattatgaacgggccgaggcaggcggcatgggccaggggcttttggaccgtctgaaactgacgcccgcaagaatccagtccatggccgacggcctgcttaaggtggctgccctggatgacccggtgggcgaggtcctttccatgaagctgcgccccaacgggctgcagatcgggcaaaagcgggtgcccataggagtgattggaatgatatacgaagcgcgccccaatgtgaccgcagatgccttcggcctttgtttcaagtcgggcaacgcagtcatattaaagggcggaagcgacgccctccagtccaataaggccatcgcacaggccctgaggaccgggctttcaagggcagggcttccggaggattccctgcagcttatagaggataccagccgggagaccaccaggaaactgatgcgcctgaaccgttatattgacgtattgatccccaggggcggggcggggcttataaagacagtggtggagaacagcaccattcctgtgattgagacaggaaccggcaactgccatgtgtatgtggatgcgtctgccgaccttatgatggccctggatattgtctttaattccaagacacagaggattggcgtgtgcaatgcatgcgagtcccttctggtgcacaggaagattgcagaggaattccttcccatgttaaagaaacgcctggatgaaaaaaatgtggagattcgggccgatgaggacgcatgcggtattgttccggaatttgtccctgccacggaggaggactggggaaaggaatacctggattatatcctgtcccttaagatcgtggattccgtggatgaggcaatttcccatatcaatacttataatacaggccattcggagtccatcgtgacatcggattatttcaatgcgcagaaattcctgaacgaggtggacgctgcggctgtgtatgtcaatgcctccacccgttttacggacggcgacgagtttgggtttggcgctgaaatcggcatcagcacccagaagctccacgccaggggccccatgggcttaaaggaactgaccaccaccaaatacattatttacggggacggccagatccggtaaaaccatagaaaagaggtaacaacatgtccatagaggaaatggaagagacagaagaccaaaaggaacggggaaggagccgcaggcagaaggaggaggaacccttcagctggaaaaaggaaatcatcagctggatccagatcatcatagcagccgtggtgattgccctggtccttaacaacttcatcattgccaacagccgtgtgccaaccggctccatggagaacacgattatgtccaaaagcagggtgattggctccaggctgtcctatataaacagtgaccctgagcgtggagacgtgattattttcaagttcccggacaacagggagctttattatgtgaaaagggtaatcgggcttccgggcgagaccgtgaacatcattgacggaaaggtctatatcaatgattccgacacgcccctggatgaaccttatctgccagaacccatggaaggctcctacggtccctacacggtgccggagggctgctatttcatgatgggcgacaaccggaacaattcactggacgccaggttctggaagaaccagttcgtaccaaagaaggatatcatggcaaaagtactgttctgctattatccaagaatcgggaaagtggagtagatgacaggatgaacataatcatatcacctgccaagaagatgaatgtcagggaagatgagctggatccggtcaatcttccctgtttcctttcaaaggcagaaacattaaaagaatacataagaagcctgagcctggaacaggcaaggaccctctgggcgtgcaatgaagcgattgccgggcttaactatgagcgttttcagaccatggacctgaccggacggctgtcaccggcccttctgtcctatgagggaatccagtaccagtacatggcgccgggggtgtttgagacaaggcactgggactatgtacagaagcatttaaggatattgtcgggattttacgggattttgcggccgctggacggaatcgtgccgtaccgcctggaaatgcaggcaaaggtaaagctgccgccggaacgcgcagggcaggaggaaatcacaagcctgtatggatactggggggatcttctgtaccgggaactggtaagggaggacaaggtggtggttaaccttgcttcgaaggaatacagcaaggccatagaacctttcctgacgccggacatcacatacctgacctgtgtgttcggtgtactggagacggataaggagggccggcccaaagtaaaggtaaaggccacggaggctaaaatggcccgtggcgagatggtgcgtttcatggcggaacaccaggtggaaagcccggaggagctgaaaggctttgacgggctggggtattgctatcacggggaactgtccggtgaaacggagtatgtgttcctgaaagggaaactttgaaaatgaatgggccggataaggcgcggacgggaaatgtctgcatcttatccggttttttacatgaaacaatgctactgctgtccaagaatctgcctgatatcctcctcgggcgttgaaaccggatggatgtcaaactgttccaccaggtagtttaacacgcccggggatacaaaggccggcagcgtaggcccgagatagatgttccggattcccaggtgcaggaggcttaagaggatacacacagccttctgctcataccaggagagcaccagggtcagagggaggtcattgacactgcagtcaaaggccttggccaatgccacagccacctttacggcgccgtaagcgtcattgcactgtcccatgtccaaaagccttggcagtcctgccacggttcccaggtccaggtcgttgaagcggtatttgccgcaggccagggtcaggatgatggaatcctttggcgcctgttttacgaattcagtgtagtagttcctgcccggacgggcgccgtcacatcctcctacaaggaagaaccggctgatatccccgtttttaacgccctcaatcacggtcccggcagcggcaaggatggcttcgtggccaaagcccgtggtaaggctggtcccgccgttgatgccggtcatggccacatccctgtcatagccgcctaattccagggccttttcaatgacaggggtgaagtccttcccatccccgatatggaccatcccggggtaggccacgaccgaggtggtgaagacgcggtcctggtaggacggttttaccggcatcaggcagttggtggtaaagagcacaggggccgggatatggtcaaattccttttgctggttctgccatgcggtcccaaagttccctttcagatgaggatacttcctgaggttcggatatgcatgggcgggaagcatttccccgtgggtgtatatgttgatcccggttccctgggtctgctttaagagctgttccaggtcatggaggtcgtggccggagatgacaatgaacggtcccttttcaatggccatggaaacccgggccggagccgggatgccataagtctccctgttggccctgtcaagcagctccatgcactccaggttcaccttgccggactccatcacaagaggaagcaggtcttccatggcatagccgtcatagcccactgcaaaaagccctttgtagaaaaaggaagtgacggacggatcctcatagccaaggacgcgggcgtggaaggcataggcggccatgcccctcatgccaaagaggagaagggatttaagggaacggatatcctcgttttccgtccacagggaatccaggtcatagccgtcattttttgcacactgggaagtgcatccatggcagagcggtgaaaggctgtttttcacctcccggacttgttgtgtcagctgtctcagggaagcatcatcaaagtttacattggtcagggttgcaaaaagcccttccaggatcagctggtccgcttctttgggcggggcggtgttatcagccgccctggcaagaccgattaaggctccggtcagttcatcctgcagttttgcggtgtttgcggtttttccgcagacaccggcctttcctgtacatccgctgcatccggcggtctgttcgcattgaaaacaaaacatttcatggctcatatatggtttcctccttgttatgggtgatgatccggatatgtccggcttgactgttatgggtggagtatactataatcttgacaacatgtatgttgttctgacaacggaaaggagaaaatatgaatatccgtattttatcgggtaccccgctgttccagggaatcaaggagcaggagatagaggccatgctgcagtgcctctctgcggaggaaaaggagtttgaaaaggatgcctatatatacaggacaggggatatcacgggccgtctgggaatcgtgatggaaggttccgtcaatatcataaaggatgatgtgtgggggaaccggaaaatcattgagaatatcgggcagggccagatttttgcggagacgtacgcgtgccttaagggggaggccatgatggtggacgtgcaggctttaggacccgccagggtgctgttcgtggacgttaagcgcatcctgaccacatgtccttctgcctgtgatttccatgccaggctgatacgcagcctgatgtatgtgctggcccataagaacctggtcctcacaaagaagatggatgtgatcacacccaagtccctcagggagcgggtcctggtatacctgtcccaggaatcggtgaagcaggggaaccggatggtcacggttccctttaacaggcagcagatggcggattatctttccgtggacagaagcgcgctgtccggggagctttctagaatgcagaaggaaggcgtgattgcctatgagaagaaccgctttcagattttgtgacggttccgtaattagcttgtcatcagcctgtcatcaggcattggcagtaattaccacttgaaaacgaacatatgttcctgtatagtgaaaacaggaggtgagggtaatggctgctttgaacatacccatacagctggttggggcgtgcagcacgctgggcgacatgacgccgttgtggttccggtatgagaatgaagagcacgccgttgttacggttaaagtggaggaagttgtttcgtcaaaggaagaaagatactgcgggatggattatatcagctttgtgtgctgggctgcggcagaagggcagaggcggctcattgaactgcgctaccgggtgtccacccacaagtggtcattgttcaggaccttatcataggaggacggacaggaagggaagatggaagagttgtggtatcacgtggatgtcaacagcgcgttcctcagctggagcgctgcccatgagatctggattaaaggcggggacctggacctgcgcaccgtgccgtccgtgataggcggaagtgagaaggaccgccacggcattgtgctggccaagtcaggaccggcggcgcggtttggcatcaggacaggggagacactggtggaggccaggaaccggtgtccggggcttatcatagcgccgcctgattatgacctgtatgtacaatgttccaaggccctcatggaattgctgggccggtattcccaccatatccaccagtacagcatcgatgaagccttctgcgccatggacggcacgaagaacctgtgggggaatccggtggcctttgcacagcagataggggcggaaatccgccgtacccttggatttacggttaatatcggggtctcggataacaaactgctggccaagatggcatcgggattccagaagcccgacaaggtccacaccctgtttaagggcgaaatcccaaagaaaatgtggcccctgccggtggaggacctgttctgggtggggcgcgccgccagccggaagctgagaacccttggaatccgcaccatcggggatttggcggcagcggaccgtggactgatgaaacagcatttgaaaaaacacggggaatttatctgggaccacgccaacggcagggatacctccccctttttgcaggaactgccggagaataagggatatgggaattccatgacggttcccatggatgtgacggatgcagatacagcccgccaggtcatcctttcccttacggagacagtgtgcgccaggctgcgggcggatgggatgaaggcgggctgtgtgggcatatccattacggaccgggatttcaggcatgcctcgcgccagaggaccctggtctcggccacccatacaacccttgagatgtaccgggcggcctgtctcatatttgaagaactgtgggacctggcccccatccgccagatgggggtccataccagccgggttacccatgatacggcctatcagtacaatctgttcgatatggaccgttatgagaaatacgccaggctggacgaggccattgacgggatacgcagccggcacggcgaggattctgtcatgcgggccgtatttcttggcgggaacctgccccatatgggcggcgggattgacaaggccaaacggaccgggatgaccaagcccctgccttactgtccttgggaataaaccccatgtccaacccatccccgtcccttattcttcaatgtctccgtttttccagcgctggcggtattccctgggcgtcattcccgtttttttcttaaagaccttggtaaaataattggcatcggaaaacccggtttcctgcgctatgtctgaaatgaatccggaggtggtgcggatcaggaagcaggccgcggatacacggcgttcctggatataatccgtgatattccgtccggtgacatttttgtatgtggtgcttaagtaggcggaactcataaacacatgctgggcaatgtctttcaggggaagggggccggagatattctggttgatatagttttccaccttttttatgacttcatggtactccagggaaaagaccttttcatccaggagacggctgttgatcatcccggcgattagctttatcccttccactgcctctgtaccgatcattggctgggagtggtattttttatataatgcatccggctctgtttcgcatagcagggccagcttcctggcatattccttgtccagtccggcatccctggtgcggaactgcccgatgattaggaaaccgatatagatattgtcaatatatacaggatatgcaacctcaatcaggccggcatggcaatgataggcataggcgtgcttctgccgggcgcactgctggtccgcctgctggtcacaatgcgcacagaaggcgttggtggcaggacagcgctccatggcatagcagaaggggaggttccgcttcgacgccccaaaccactgcttggattccgttgcataaaaaagcactggagtttttaaaagttttgatatgggatttaaaatggaaaccatttttgccgtattgatatggaccctgtatgtctgcacgaaaaccacccctccctgaatgccgttatcagttctattattgtatcacggttaaaagggaaaaagtagtaaaattttacgtttctaataaatggtaaaattaatctcaggatatgggaaacctgttaaggatgatactttttccgtatttgtaatagtaatttatttttaggattttacacgcccattgatatggggagacagaatacatgattttatttccatcataggacgggaacaggccctcctgacagaaaaatattactatttttacgccattgcccccagtccggatccgcgatttgcaggcgcccttttatcttgctataatacccttgtacactgagggtaagtgtgtataattataccaattcacaacaaaggagaatgggagattatgttaaaaaaatcaatggcagcccttttggcggcagcgatggtaatgtccgcgctgaccgggtgctccggttccaaagacagcgcggatccgggaaaagaacctcaggcatcccaggaagcatcaaaagatgcaggggatggatcggatgaagtagtgttaaccatgtggtattggaagaacagcatacgggaggacctgattgcacaggtatcggaacagttcccgggagtcaccatccgggcagagctgttttccgccgacgatatagaagagaagatcaacaccaccattgcaagcggcggggaactgccggacctgcttcccatggatgactggattgccaaccttctccagtatccggatatgtttgtggacctctatgaggctccctgcaatgcaaaggagatagaagaccagtatgtggagtggaagtggaaacgtggggagaccgttgacggcaggctgattgcccttcccatggacatcggacccacctgcatgttctataacgccagcctgtttgaggcggcggggcttcccacggagccggcggatgtggcggcagccatgtccacctgggaggatgcatatgcggcggccaggaagctgcaggaagcaaccccggatgtaaagatgtttgatttcatgggccacctgtttgtggcggcattgggacagcagccccagcacatgattgatgaagagggtaacttcattgcggaccaggatcatatcaggcaggcattcatgaccgcagtggaaggaaagccctatgtgtacggcggtgacaccgaatggtcctcggagtgggctgcatcgctgaacaacggggacgtggctgcctttgtgggcgctgtgtggatgaagccggagcttcaggacgctgcgccggatacggccggacagtggagggtgaccaccgcaccgggcggggccggcaatgtgggcggttcttccatcggcatcactaagaactgtaaaaatgtagagacggcatacaaggtgctgacctggatgaccaacacggaaaaccaggtggaatccctggaacagctgggcctgttcccgtccctgatttccgccctggatgaccctgcgctgatgtacgaggaggaatttttcggcaatcaggttgccaatgagtattttgtgaaggctgcaaaggaaatcaaggattattactatcctcccaactacagttcctaccagtctgcgtttgagcagcagctcctgctggtccaggaccaggataaggatcctgaggaggcattggcggatgcggtaaaagaggcaaaacagatttatgatttggaatacatgaaataaacttgatggtatgggccgctgccaagtggcccatcatttgattctgacctggatgatcgtatgattttcatgaaagggcaggccgtggagggaaacagtcaatgaagcaaaggatgaaaccacaggaaaaaaatgggaaaaggctccggggattactccatgacatctataagaacaggatgatatacctgctgatcagcccgttctttttcatatacgggatattctggatatttcccattttctattctttttttctctcattccataaatggggaggcgtgggggagaagaagtttgtaggacttttttatttccagcatctcttacaggacagcacgttcctgctgtcaatcaagaacacgctgatcatatgggtgctgtcgaccattcccatggtcattatcgcagtcatactggcattcctgctgaacggcgcatttttaaagggaaagaactttttccgcaccgtgtactatctgccaaatatcacctcgaccgtggccgttgccattgtgtttgccaatatattcggcaacaaatatggaatactcaacttcctgatcagccgtctggggtttgacccggttcagtggatgtcccttacctggggcgtgcatgtggccattgcggccattgtcatatggaggtggaccggttataacgccatcatcctgttagccgggctgcagaagatatccagctcgctttatgaggcggccagcctggacggggcatccacgttccagatattccgttacatcacggtgcccctgctgaatccggtcatccagtttgtggtaatcacctccaccatcggaggatggcagctgtttgcggaagcccagatgctggtggggacagcaggcgggattggcaagagcggcatgacggtggtgctgtatctttataaccaggccttcggcaaccggcagttcggctacggttcagccatctcctgggcgctggtggtgatcatcggcttctgttccctggttaactggcttcttaccaaacgggaggtggactgatatgacggtgaataaagcggtatccaaaatccttttgtacggattcattatcctgggggcgcttatatccctgttccccttttactggctggctgtcatggctaccaacagttcagcggcattcatgcggttcccgccggtcatggtgttcggcggacagttcatgaccaacatgaccaatcttttgaactccatccagtttggaagggctatgttcaacacctttgtggtggctgtatgcaagacagtgggcggtgtgtttttctgttccctggcatccttttactttgcaaagtttaaattccccggcaggaggtttttatttgcactgtgcctggtgaccatgatgatcccgccccagctcaacctgataccacagctgatcatcatgaataagtttggctggctctccaccttcaaggcgctaatccttcccggactgattccggcctttggcatctactggatgaaccagtactgtattgggtccatacacgacgacctgatccattctgccaggattgacggctgcggcaccttcggcctgttcctccatgtgggactgcccatcatggttccgggctgtgccttcttatgtatttatatattcatggacagctggaatgattatctgtggccgttgattgtgaccaacgattccagtaggaatacccttcaggtggccctggcccagctccagggggcatacaacagtacggattacggcatggtcatgtgcggcgtccttctggctaccttgccgctgttcattatattcctgctgttcagccgccagttcacggcagatatcacggcaggcgcaatcaaatcataaaatgggaaagatgagggaaagatggaatgcagaaatactgcaatttaaacctgggatggagatttaaagagggatttaaggaagaatacataacaggcggcaatgatgaggagggcaggctggttaatgtgccccatacggtgaaggagattccctatgactgctttgaccagaccatgacctgcatggtatccacctatatacgcagcttccggctcccggacatggaggggaaacgtgcgctggtttcatttgaaggggtttccgcctgctatgatttatatataaatggccataaggcaggcagccacaaaggggcttactccatggcactgtttgatattacggagtatgtcaccgcgggtgggaaccggatggtcctttgcgtggactcccatgagagaagcgatataccgcccaacggttcaaccgtggacttcctgatttatggagggatatacagggatgtgaccctgtatatccaggaagggacatatgtgaagcaggccctgttccgctacagcctggaccatgaaacggcggtcatggagccggaactcctgataggaagccatgggccaaaacgggaactgtgggcagtgacattcctgcagaaggatggggtccctgtctgggaaaacaggcagaagatacaggtttcaccgggcaccggaagcatttccctggaacccgggcatgtgggacaggtagcgctgtggcagccggaggatccccagctgtaccaggccagcgttgaactgcaggatgaagatggccggtgcgtggatcggtatcagaccaggattgggttcaggacaatacgggtggagccggacggattctatctgaatgggaaacggacaaaactgatcgggctgaaccgccaccagtcttatccgtatgtgggatatgccatgggaaggcgggcacaggaaaaggatgccctgctgctgaaggaattcatggggcttaacatggtgcgctgctcccattatatgcagtcacggtacttcctggataagtgcgatgagctggggcttatggtctttgaggaaatcccgggctggggatatatcggggatgaggaatttaaaaagattgtattccaggatttggaaaatatggtactgggacattttaaccatccgggtattgtgatatggggaacgcgtctgaatgagacaacggaccatgacgggctttaccaggaaaccaaccggcgctgcaaggccatggatccttccaggcccaccacgggcgtgcgctgggagaccggcagccacctgattgaggacatatacagctataatgattacagtgaggacgataagggggagcatatgctgctgaccgcccatcaggccacgggcagcacgaaacggatgccgtatctggtgagtgagcataccggggctgtccttcccacgaagccggtggactcagaggaacggcaggaagagttcgcgatccgccatgcaagggccatgagtaagatcatgacatccgaccagtatctggggggccttgggtggtgcatgtttgactacaacacccacaatgaccacaattccgttaacaaggtatgttaccatggggtgctggatatgttccgcgtgcccaagtgggcagcatatctgtatgcaagccagaaatccccggataaaggggctgtcctggttccctgttccatggtaggaaggggggaacgctgtgagccggttcccttttatgtgctgacaaactgtgactatattgaggtcaccctgtcaaatgacataacaaggacctattatcccagcgttaaatttccggggcttgcccatcctccggtgcttgtgactgagaacggcgagttctggcagcacagatggaccggggccaggattgtgggatatgttgggggccaggcagtggcggagaagcggtattcagataatccgagactgtcgcagctgctggtccagccggatgacacggtcctttataacgaccaggtggatgagacacgggtggtctgtacctttatggatgagttcggcaaccgtctgtaccatcacatggaagcggtcagcgtgtctgtaagcggggatatcgaactgatcgggccgtccctgatcccgtccatgggaggctgcgcggccttctgggtacggacgtgcgcaagcggtacaagggggacagccggcatacatatccacacctccaggccggagattgacggccagacagtcaccatacgtctggaactgtccggccaggaaggctgacgggattccttttgaaacaatgcaggggaaacgttttttgaaaaacctggattgacttctgggatattttaatataaaattcatactgttaatgattataattggctggaccatgcggtccagccagcttgcgtgttacagcatgcccgaaaccgccggtttccggctgcataaaggaagaaacagtaaggagcagatgaatggaaggatccaggactacaatagaagaaagagacatgacaccgccggccatggagccggaacgccagcagtacttcatggaacgggccagattacaggtaaaggagctctcagaccgtctgggacggcccctgacctgctgtatcaacaccttcgggtgccagatgaacgccagggattcggagaagcttctgggcattctggaaaccatcggctacagggccgtggaatctgaggaggctgactttgtcctttacaatacctgcacggtgcgtgaaaatgccaacctgcgcgtatacgggcgcctgggccagctgggcgcctataagaagaagcatccacagatgatgattgcgctctgcgggtgcatgatgcaggaaaaggaagtggtggacaagattaagaagagttaccgctatgtggatttaatattcgggacccacaacatcttcaagctggcggaactggtatccctttgcctggacagccgcaaaaaggaggatgaaagcaggaaggcagccgaagggacccctgtcaagggccataagcataagatggtcatagacgtgtgggaggacacggaccagattgtggaggacctgcctgtggagcgcaagtacccctttaagtccggggtcaacatcatgttcgggtgcaataatttctgcagctactgcattgtgccctatgtgcgcgggcgggagagaagcaggaagccggaggaaatcataaaggaaatccgcaggctggcgtccgacggcgtggtggaagtcatgctgttaggccagaatgtgaattcctacggtaagaacctggaaacgcccatgacctttgccgggcttttaagggaggtggagaaggtggagggaatccgccgcatccgcttcatgacatcccatccaaaggatctgtccgatgaactgattgaggtgatggccgggtccggaaaaatctgccgccacctgcaccttcccctccagtcgggaagcagccgcatcctaaaagagatgaaccgccattacaccaaggaacagttcctcgacctggcggcgcggataaaggcagcggttccgggcatttccctgacaaccgatatcatagtcggattcccgggggagacagaggaagatttccttgagacactggacgtggtgcgcagggtgggatttgacagcgcgtttaccttcatctattccaagcgcacgggaacgcctgcggccgccatggaggaccaggtaccggaggacgtggtgaaggagcggtttgaccgcctgttaaaagaggtacaggatatctccgcagaggtctgctgccgtgatgaacataccgtacaggaggtgctggtggaggaggtcaatgaccattcccctgagcttatgacaggacgcctgtccaataataccgtggtgcatttcccgggcgatgcctccctgattgggaagctggttcctgtttacctggaggagagcaggggattctactacatgggaaaacaggtggacggggcgctataaggttccggtatggaaagacagcaaagataaaagcagtccgtgcgccgggctttggtgcggggactgatagagaagagaggtcagcattttgatacaggcacaattatcacccatgatgcagcattacatggagacaaaaaaggaatacccggactgcatcctgttttacaggctgggggatttttacgagatgttttttgacgacgcccttacggtttccaaggagctggagataacccttacgggaaaggactgcggccttgcggagcgcgcccccatgtgcggcgtcccctatcatgccttggacgcctacctgtaccgcctggtgcagaagggatataaggttgccatcgcagagcaggtggaggacccgaagctggcaaagggacttgtgaagcgggaggtcatccgggtggtgacgccgggaaccattacaagcgtccaggccctggatgagacaaagaacaactacctgatgggcattgtctatgaggtgggccagcggacgaaccagacgggcaaaggcagggatgggatatacggcatcgccaccgcggacatcaccacaggggatttcatggtcacggaggtggattcggaccgggaattgtttgatgaaatcaacaagttttccccgtcggaaatcatctgcaacaatgccttttatatgtcaggggtggacattgacgggttaaagaaccgctataatgtaatcatatcagccctggacagccatttcttcggggaagagtcctgccggaaggtgctgcgggagcatttccgagttggctccttaagcgggctgggccttacggattacgggaccgggatcatttccgcgggcgccgtgatgcagtacatgtatgaaacacagaaaagcaccctggagcatatcaccaccatcaccccctattccaccggacagttcatggtcattgacacgtccaccagaaggaacctggagctggtggagactatgcgggaaaaacagaagagggggacccttctgtgggtgcttgacaagaccaagacagccatgggcgcccgtctgctgcgcacgtacatcgaacagcccctgatccataaggaagagatcgtaaagcgccagacagccgtggaagagctgaacatgaattatatttccagggaggaaatctgcgaatacctgaatcccatctatgacctggaacgtctgattgggcgcatcagctataagacagccaatccaagggacctgattgcatttaagaactccctggaaatgcttccgcatattaagcagatcctgggggagttttccggggagctgttaagaggactggcgcaggaaatggacccgctccaggatatctatggactgattgaccaggccatcctggaggacccgcccgtgaccgtgcgggagggaggcatcatcaaggacggataccatgaggaggcggaccggctgcgccaggccaagacagaaggcaaggactggctggcggagttggaggcaagggaaaaagaaaaaacaggcatcaagacgctgaaaatcaagttcaacaaggtgttcggatactattttgaagtgaccaattcctttaaggaccaggtgccggattactttgtgcgcaagcagaccctgaccaatgcggagcgttttaccacggatgagttaaagcatctggaggatatcatcatgggggctgaggagaagctggtttccctggaatacgacctgttctgccaggtcagggacagcattgcggcccaggtggtccgcatccagaaaacagccaaggccattgcgggcgtggatgtgttctgttccctgtcagtggtggcgacccggaggaactatgtgaagcccatgatgaatgaaaagggtgtgatccagattaagaacggccgccatcccgtggtggagcagatgatgcgggacgacctgtttgtggccaacgatacgttcctcgacaacgggaagaaccgcctgtccgtcatcacaggacccaacatggcgggtaaatccacctacatgcgccaggtggccctgattgtgctcatggcccagttaggaagctttgtcccggcccaggaagcggatatcgggatctgcgaccgcatcttcaccagggtgggggcttccgacgacctggccagcggtcagagcaccttcatggtggaaatgaccgaggtggccaacatcctgcgcaatgccaccaggaacagccttctggtcctggacgagattggaaggggaaccagtacctttgacggcctgtccattgcgtgggccgtgattgaacatatcagcagcacgaagcttctgggggcgaagaccctttttgccacccactaccatgaactgaccgagttggagggcaccatcgcaggggtgaaaaactactgcattgcggtaaaggagcagggggacgacatcgtgttcctgcgcaagatcgtgcggggcggggcggataagagctacggcatccaggttgccaagctggcaggggtgccggattccgtcattgccagggccaaggagattgcagaggaactgagcgatgcggacatcacggccagggccaaggagatagcggagatcagctccaacattacacagcacaaggcggtccccaagccggatgaagtggacatgcagcagctcaccttctttgatacggtgaaggatgatgatattgtaagggagcttgacgggctggagctgtcaaccatgacgcccatcgacgccctcaacaccctgtaccggctccagacaaagcttaagaaccggtggaaggagacacaatgaagttccatatactgacacttttccctgaaatggtcatgaacgggctgggcaccagtattacgggccgggccatggcaagcggcgccatctcggtggatgccattgatatcagggattattcaaaggataaacacaggcatgtggatgatgcgccttacggcggcggcgccggaatggtgatgcagcccgggcctgtgtgcgatgcatatgaggacttgtgtaacaggacggggaaaaagcccagggtcatctacatgacgccccagggcagggtgttcaaccagtccattgcagaggaactggcacaggaggaggaacttgtattcctgtgcggccactatgaggggatagatgaaagggcgttggagctgattgtgacggattacctgtcggtgggggattttgtcctgaccggaggggagcttccggccatggtcatgattgactgtatctccaggctggtgcccggggtcctgaacaatgaggtgtccgcagaggtggaatccttccatgacaatctgctggaatacccccagtacaccaggccggaggtgttccgcggaaaggaagtgcccgaggtgcttttaagcggacaccataagaacattgaggaatggcgcaggaaggagtccatcaaacggaccctggagcgcaggcccgaccttctgcccggcgccagcctgacccttaaggagcaccggtacctggattcgcttaaagggggagaggacggccttgtggagctggaggaaatcctggacggctatgcggctgaggcggagcggttgttctgtaagagggacgggatccgcggtcaggaggaccgggctgccgttcaagaggaccgggctgccgttcaagaggaccgggcggccgtacaggaagaccggcagtccgcccgggaggacaggaaagttaccggcctgaccggcccgcttcccggactgggggaacccgcgccgagaatcaagcgcagggccatgtccgaggtgaagaaactgctggctttgggcggctgtaccctgaacgatgtaaaaagttattataaagtatgtaaagtacagtttacaagggactacacagggtaacggtctgacgggaggattaccgcccgtcagattttccatgtaatgttcaagctgtcgcttgtggcggcaacggtggtaatcatcaaatccaccacccgccgcttgtcgtcaaaggatacatcgtcccatgtgtcgaggtagccggaaatctggttgacctgtcccgggctgatggtttccaccgtcagctcggctatctgcttcacaagttcctgcttgcgcccgtccagttccgctatcttcacattcacataggagagcaggacattgttcgcgcccgtcagactgtccaccagcttttcaatctcgctgtccacatggagaagctctacttgcagggcggcgattttgggattggcctttgccgctttcttcctgcccgtcagcgtcttgtgcttttccagcttcttcaccatctgctggtaaaccaccgcttccagttcggaagtgatgattttcccacagcccggacagcttttattgtccagccgtttcgtacagcggagatattgcctgccggacggattgaagatactcataagcgcatatccgcagttcccgcacttgattttccccgccagccatgtgtgggtggcttttcgggcggactggattttcatgttgttcatcagcttcttgcggcaagccagccatatatccgccggaacaatgccctcatggggagccagcaccagcatttggtctttcaagtcgtttttcttgctgggcttcacatcccgcccctgatacagataacagccgtttgtccccgtaaagtcggcggcgtcattgacgataaccgtaccctggcttttgaaaaattcgtacacatccaagtccgcctgcacatagacgggattgcgtaacatctgcgccagtgtggggcgtatcagttccttgccgtagaacaaaatcccctgttcggcaaagtaccgggtaatgtccccgtaagaggttgtgggctgggcgtacatctcaaatatcagccggatattggccgcttcgtccgggtttaccaccagcttctttgtgttgataccgtccattttgataggctcggtgtggaagccgtaaggggctttcccgcccatcttgaagccccgctgactgcgggagtagtaagcgtctgtcacccgcttctgtatcgtttcccgttcaagctgggcgaacacgatacagatattcagcatagcccgccccatcggggtggaggtatcaaacttctccgtagaggacacaaactccacatcgtactgctggaacagttccatcatgttggcaaagtccagaatggaacggctgatacggtcaagtttgtaaacaatgacctttgcaatcaagccccgcttaatatcccgcaccagttcctgaaacttcgggcggtctgtgttcttgccgctgtaccctttgtctgtgtattccttacagttcccgcctttcaattcgtatttgcaaaactcaatctggctttcaatggaaatgctgtcctttttgtctaccgattgccttgcatagatcgcgtctatcctgttattcattttgtcgctccttttcttaaaaagaaacggagctgctgacagttctattataccgccagcagccccgcaaatcaacgatggcttcgggatttatgccccggcttcctctttctgccgcttatcggcatatttgcggaacacctcataaagctgctgctccagttcccggcgtttggtcgcttcctgctccggcgtgaacaccggggagaggttttccagcgtgatttcctttccctgaaaagtcacgacttctgtttcctttttgtatctgatattgttacttataaaatcacctttcctttccatactgccgctgctgccgtttcagttccgccagtatatccggcgggatacggtcaaccagcctttgcatatcgtgcagttcgctttccagctttgcccgctccatgcggtctttgattttgccgctctcgctggctctggctcgtgcttccagcttctcattttctgccagcaggtcattgattgtgaccttgtactttttcaactgcccggagaaattctccatctgcgggaaccactttttcagcatggagagggcttcctcttttttctttccggcgttcagcgggttaatgccgtccagtgtggcttcaatggctcttgcctgccgggagagggaaaccgcctgtttgaaaagccgggtggggatatgcttccggcctgtcttgctggcgctttccccacgctccaagtcgggatatttctccaccatgtaggcgtgaaaatcatcctgccacttcgtcaggtttgcccggttgccgataatctccttagcgcacaggcggttgtcctttgtcagcggaacaaaggtcaaatgcaggtggggcgttttctcgtccatgtgtaccaccgccgacacgatattttcccgccctacccggtgggtgaggaaatccgccgccctctggaaaaacgcctgtatctcctttggggatttccccttgaaaaactccgggctggcggttatcagcgtatcgacaaaccgtgtgctgtccttgcgggttcggcacccggcctgctcaatccggctctgaatgaagtggtaatagcgtccctccggcttgacgatatggaagttgtatttgctccggctggtgtcaatatcagggttgctggcgtattggtctttctgccgttcgtgatgggcttccagcggccttgccgggttgcccttgtgcttctcaaaacgcaaaattgcgtgctgtgccattctgctcctttccccattcctttcctatccggggttttccacagggaaaatcccgcagaaaatagctcggataggattggaatggatagaatataaatcaatctttttaatctttgtatttctatataccgtccggttttcgtacttctcaggagtgatttccgtacttcatgggtacggttttcagccctccggcgtaccagaacgggatttcttgaagtcggtgttcggaaccgcttcataggattttgggaaaatgcggttgggttttccacagccctgcttctggatctccaccagtccggcatattgcagttcccgcatggtatttaccgctttctgccgcccacagcggagcaggtcaactacctcgcagatgggatagtacaggtaaatccgcccgtactcgtccgcccacccattcttgcgggataactctgtccggcgcaggataaaggcgtacaacacctttgcctcgttggacaggggcttgaatgtaggggcttcaaagagaaaattcgggagccgggtgaagctgaacgcctgttccggctggtgaatgtaaatcgtgtttgtcatatcgtgttttgtggacggttagaagcccgttttccggggcgggcgatactttataccacctgccccggtttggggcctgcgaagccttataaatcaaggcttttccgctcctaactgtccacagcagacctccttttccgttcactttctgttttctgccgcctgtgaactctggcggcgcagtccgggcagtatttagcccggttggatttggggacgaacacgccgccgcaaaccgcacagcgtttcatgtccttatcccggaaaatctccgctttcagcgtcccgtccagcggcaagaccgcccagcggaaccacttacagcagaccgagaaagaaaccgtctgcgggcaggtgcaggcgtccccatcgtcaaggacaatgcagttgccgtcctcacagcaacagcactcccggcgtatcaggctggccgcctgtttcttctgcgccggtgtcatgcggtaaagggaaccgtccggcctgcgttccagcggcggcaagtctttataggggttatctctcatgcgttccctccattttgctttccattgccgttctccccgaaaaggtttcctgcctcgtcgtcgcaagctgcgtatcgctcgtttcgccgcaagcggcaaaactcactcgctccgctgctcctcctctccccacaaagccatgcggctttgcgggggccccgacaatagcggcgtattccggcgttggcacgctccccgcagcttcgggacgttttgtcccgaagtgacctctggacaaagtgtccaaaagtccggctcctggcggtgcttccccagccgtggtattctcttttcggacggtcattctgttttcaaggtgctgtccatcgatgaactaccctaagtctacacgaaaaaaatgcaaatcccggctttttgcgagaattgcattttgatgaagtttacactttggaaattgcatttttgcaattatcttgtataatggaagtatgcggaggaggtgcgtgtctatggctttacccggaacacccggacagcggatttccgatttatgcaacgggaaccacatcacacaaaaggaacttgcggagaagataggcgtttccgcttcccaattgagccgcattgtcagcggcgaaacaagaacggtaagcagtgatattctcataggtgtggcaaaggaatttaaggtatcgacagactacatactgggcttgtctaccgtgagcgtccgtaaaagttacgatatttctgaattaggcttgtcagagggggccgtgagggggcttgtgacgggtgctgttgatgtgcaaatcctcaaccgtctgttggaacacaggaattttcccaagctgatagatttgatacggatttattttcaggatacggcggcaaagggcataacagcaagaaaccagcttatcgagatggcaacggcttccctgtccgacctgatgaaagaacacccggaacaccgggcagaagcgaagcaggatttacagcttttgaacgcccaaaagatgggggaacatgaagcggagattgaaaaaatcaaaaatgtgttcctggctatcctgcgggacattaagaaagacatagacaacggggaacagccgggagaagctgtgaccgccgctatgttccaagccatgcgggacgcactggcggaacagaaacaaaaaccgctttccattgacgatgtaacggcgatgatagccggacagattggacagcttgcgccgatggacgaggaaaccgccgacctgtttcagcggttagtaaagaaaatgattgaacaggcagagaaataaatgtaggagaatattagaaaatgggaaaaagcaactcgtactatatgcagcttcatgtagaagcactgtttacaatgaatgaaaagaacgaacttatgactataagggaaccatgggactccacttcacagccggctccccgcttctatttgacaagaccactttacgaaaaaccacatacttattttcgtgctgacgtaccgaaagaattatgatataatgagttatcaacaaatcaaaatttgtggaggtaaaatatagatgaatcaaggaagaattattgtgattacaggctcaccggggacaggaaaaacaacaactgcgtcaattgtcgcaaaggaatcagatatggataaatcagtgcatatgcacaccgatgacttttttcattacttaagcaaaggcgcaataccaccacatttgccagaatccaacgagcaaaatctggttgtcattgaagcctttttagaagctgcaaagcgatatgctcgtggcggatatgatgtaattgtagatgggattgtcgggccatggtttttggagccatggaaagctcttgttcgggaacattatgaggtgcattatattattttaagggcaagtaaggaagaaaccttaaagcgggctgttgaacgctcaaagttagaccgaaaaacaaatatcgaattggtagaaacaatgtgggagcaattttgcaatctgggaatatatgaatcgaatgttgtagatacgaccaattattccattcaagaaactgtttccgcagtacaagaaaaaatcgcaagtagggcagcattgttgtcttagattgttttggtgcaattcccatttatcgagcagatgaagttggggagccgcctggaggcggcggtgccgaaggataaaataggagatgttaaggttatgaataatgaatacgataatgagaagttttttgaagaatatgcaaagatgtcccgcagtaaagaggggttaaaagctgctggtgaatggcatcaattaaaacctttgtttccttcgttagaaggaaaatctgttcttgacttggggtgcggatatggctggcactgcaagttcgcagaagaacaaggagctacaaaaatattagggatcgatttaagtaagaaaatgattgaggaagcccaaaagcgcaattcaggaaatcaaattgaatatcgtattagcggattagaggaatatgactatccagaaaatgaatgggattgtgttatatctaatttagctctgcactatatagaggacatagtggaaatatttcaaaaagtgtataggacattaaaaccaggtggaatttttctttttaatatcgaacaccctgtttttaccgcaggagttgggcaggattggatttatacagatgatgggaaaccgcaatattgggcgattgataattactttataacaggagaacgaaatacacattttttaggatgtgatgtagtaaaacaacatcacacacttacacagattataatgggattgctgaacaatgggtttgagcttaaagttgtagaggaagcagaaccgcctaaagagatgatggatattccgggtatggaagatgaacttcgccgcccgatgatgttacttgtaaaggcgatagcgaaaaaataatatctctattaggaaaactgatataccccaatttagagaatggcatagtaattcctagtgataaagagaaaatgattgcactggcaaataaatacattgaaaaagaaaatgtagatgcactcattctcgcctgtacggagctgccacttgccataaagcccgaagatgttaatgtgccaatcgtgaatacaacccaagtacatatcaatgcaatttaccaatatgcaattcgataaaaatagcaaagccagccgagccagtcaacggtcaagatgaacggcgcatttcatgcgccgccgttgacagccccgcccgtctttgctaaagggtaatcaaggcgggaaagccctaaaatggcttcacacctatttcaataattggaggagataaaaatgagatcagaaaaggaagtttatgatattgttttgaattttgcaaaaacagacaaacgcattcgcatggttactttggaaggatctagaacaaatacaaatattccgcctgatgattttcaggattttgatattactttttttgttacggatatggacagcttcacaagtgatgataaatggctagatatatttggtgaaaggttgattctgcaaaagccggaagatatggaattatttccagctgtagaaaagggattttcatatttaatgctgtttactgatgatgttaagatagatttaactttgctgccgctggaactgatagacgagtattttacatgggataaactggtaaagttactgttggataaagacaaccgtatcgtaaagccgccaataccaacggatatagactaccacttgcagaagcctactcaaagaatgtttgacgattgctgtaatgaattttggaatactacaacatatgtagtaaagggcttatgccgcaaagaaattctttttgctattgaccatatgaatgatatagtacgaaaagaattgcttcgcatgatttcctggctgattggtatcaaacagggatttcatttcagtttgggaaaaaactataaatttatgaagcaatatgtcccagaggaattgtgggaacgacttatgtccacttataatatggattcctatccccatatgtgggaatcctttgaacaatgtatggcattgttccgggaggtttcgtcagaagtggcatgccagttggattaccagtatccactatatgatgaaaaaatcagtaattatgtgattcggcaaaagaaaaaatatggcattgaagatgataacaaataaaattttttcaatcgaaaaaatttattttgattattcaattttgaaaaactgaatacctcaaaatcagaaagagcgcggacaagcactttgagggattggccgccttgtccacccatccagcggggcggcgggcggcggtcaaggccgggtgtaaccccgttcatttcagccttgacggttgcccgctgtcctgctacttttccgggagtgtggccacaacttcgggacactttgtccacaagtcggagcgtaggacgagggacgggggctttcatatacctgccgccgttctctgaaaacaggccgattttttgctcattcccattcgcaaaaattcagcctgttttcctgccggagcaaacggggcgcaagaagcaccgcaccccgtttcccccgtcagccacgccagcaggtataacacactacactttgcaagcaaagtcgtgtgccaaagggggcacccctttggaaaccccggacaacaaaacaggcggtatgctgccctctccgggagcataccgccgtttgttgtcagcagcccgtttcacggtctgcgtgtagttccttgtaaactgacctaaagcgcggttaaagttaatccaaaaggattattaaaggattattaaatcccgtacaatggctgcgcggcgttgacagaagcggcataatattgtacaatctcatgaaaatacgcaaaaataggagttgatgattttggaaccatctggtgactcgatcgccatacgtttagttgttatcattattttactggggctttccgcctttttttcatcatcggagacagcccttaccactgtaaacaaaatccgcatcaggaccctggccgaggcaggcaataaatctgccgtatgggtcatgaagctgggcgaggaccagggcaggatgctcagcgccatactcattggcaacaatgtggtcaacctgtccgcctcctccatgcttacggtccttgccactgaggtgttcggcagcagggcggcaggcgcggctaccggtatccttacccttctgatattgattttcggtgaaatcacccccaagaccattgccaccctggaagcggagaagaacgccctcaggttcgggcatatcatatatgtgctgatggtcatcctgacccctgtcatcgtggcagtgaactggatgtcctccggtgtcctcaaggccctgaatgtggaccccaataagcggggggacgacatgacggaggatgaactgcggaccatcgtggaagtgggacatgaaaagggtgtgattgagtcagaagaaaaggaaatgatcaacaacgtattcgatttgggcgattctgtggccacggatatcatggtacccaggattgacatgactttcatcaatatcaatgcaggttttgatgaactgctccaggtgtttcgggaggaacgctataccaggctcccggtgtatgaggaaaccactgacaatgtggtcggcatcatcaacataaaggacatgctgctcattgaggacagggagcatttttccattgcggaccacctgcgccagcccctttatacctttgaatccaaaaagctgtcggagctcatggtggaaatgcgccagacctccaacaacatcgtcattgtgctggatgaatacggggccacggccggactgattaccctggaggatatcctggaggaaatcgtgggggacatccgggacgagtacgatgaggacgaggaggatgaactcatacagctgtcggaaggtgagtacctggtggaaggcgccatgaaactggatgatttaaaccacaagctggacctggacctggcctcggaggattatgattccgttggcggatgggtcattgaccggttggaacaccttccggcagagggggaggaagtggagtgggaaggggtacgcctggtagtggaacaggtggaaaaaaaccgcatcgacaaaatccatatctacctgcctgaaaatgagtaacagttcacatcggatgtctgaacagttacggaaatgaagaaaaaggaatgaggaaaaaggaatgaggaaaaaggcagggattaaatcataaaatgcttgcattttggaagaatatatgatagaatcagtcgttgtgacaagaaatagatggtcctctgttactgaaacgcagtgaatttgatttaccgcagatggtattaagaacatccaatagatgaaggaggttcacaccgatgaacgacattattaagaacattgaagcagcccagttaaaagaaaccgtacccacattccatgttggcgataccgttaaggtatacaacaagattaaagagggtaaccgcgagagaatccagattttcgagggaactgtcattaagagacagaacggcggagcaagggagacatttaccgtaaggaagaattccaatggtatcggcgttgagaagacctggccattacattccccaagcgttgacaacgtagaagtcgtacgtaaaggtaaagtaagacgtgctaagctgaactacttaagagacagggtcggtaaagctgccaaggttaaagaatcagttaaataatcggttatataatcaggtagtggaaacaggaacaagggacaatgcaaattgtccctttcttaaattccatatggaataatacagagaaatgggtgtggtgcatggagttttatgtgaatgaggatacggcctggctgcgccggattgtgcgttgggccgtgaacgtggtggttgtgctggcccttgcctggttcctggtatatgcgttctgtgcccaggtccctgtgtccggcaattccatgcagccggtcttgagcgccgatgacgtggtgctggtgaaccgtctggtttatgatgtgggtggaccggagcggtttgacatcgtggtgtttgagcgcgaggaccacaaaaagaacgtgaaacgtgtcatcggccttccgggggaaaccgtacagataaaaggcggtttcgtattcatcaatggtgaggtcctgggtgtggataacggtctggagcaggtgtccctggccggccgggcagacacccccatccagctggaggaggatgaatatttccttctgggggataaccgggacagcagtgaggacagccgtttctccaacataggcaatgtaaagagagagcagatatatggaaaagtctggttcaggatccttccgctcctgaagctggatttcatccattccaaatagaataggagtaatgatatgaatatacaatggtatcccggtcatatgaccaaggcgaaacgggccatgaaggaagatatcaagctgattgacctggtaatcgaactggtggatgccagggtgcccctgtccagccggaatccggatattgatgatttggccaagggaaaagccaggatggtgctgctgaataagtcggacctggcggatgagcgggttaatgcgcagtgggccgcatggtttgaggcaaaaaacatccacgccgtgaaggtggattcaagaaacaaggggaccttaaagcaggtgcagtccgttgtacaggaggcatgcaaggaaaagattgagcgggacaggaaacgtgggatcatgaaccgtcccatccgcaccatggtggttgggattcccaacgtgggcaaatccaccttcatcaattcctttgccggaaaggcatgtgcaaagaccggcaacaagcctggcgtgacaaagggaaaccagtggatccgcctcaataagacgctggagcttttagataccccgggaatcctttggcccaggtttgaggaccagagcgtggggcttaagctggctttgatcggctccatcaacgaccagatcctcaacaaggacgacctggcctgccagtgcatccgcatcctgaaggagcggtatcccggcatggtatcccaacggttcggccttgagacagaggataaggaaccggcagccatcctggaggatgtggctaggcagcgttcctgcctgatgaagggcggggagctggatattgccagggcggccgccatggtgctggatgatttcagggcaggaaaactgggacgcgtcaccctggagcggcccgaagactataaggataaagagtgaccggataggacgggacacggaaaggcagacagtggcggcaagagtattaaagggtgaaagactggaaaaggaactggcccgtctggaggccatgactgaatatgaaaaagagtatggaagcagcgccttcatatgcggtattgacgaggcgggaagaggtcccctggcaggccctgtggcggcaggcgcggtgatccttccaaaggactgccggatcctctatctcaacgattccaagaagctttcagaaaagcgcagggaggaactgtttgaggagattaaggaaaaggcggtggcatggtccgtgggcattgcgacccctgccaggattgacgaaatcaacatcctccaggccacctacgaggccatgagggaggcggtgggccagcttaccgtgaaaccggatgtgctgctcaacgatgccgtcaccataccggaccttgatatcttacaggtacccatcattaagggcgatgcaaaaagcctgtccattgcggcggccagcatcctggccaaggtcacaagggaccacatgatggcggggtacgaggaaatgttccccggctacgggtttgcaaagcacaagggctacgggacggcagcccatattgcggccatcagggaactgggaccatgccccatccacaggaggacgttcatccggaattttgtggggcagacatatgaataaacgggagacaggcagctgctatgaagaactggcagctgtttgtttacagaaaaaaggttaccgcatcattgaaaggaattaccgctgcaggcagggggaagtggacctggtctgccgtcacggaaggtacctggtgttcgtggaagtcaagtaccgttccagcggacgcatgggcgggccgctggaggcggtgaaccgggtcaaacaggaacgcatccgtgccgcagcggtttactatatgttcagccacaacatcccggaggactgtccctgccgttttgatgtggtgggaatcctggggaatcaggtggaactgatccaggatgcgttttagcaaagcctgtccggcgggcagggatataaggaatcaggagggaatgccatgtcaattaactggatatataaggacgacaggaaggttttcagcaacgtggagcgcggcggtgtgccatacctttcttttaaggcgctggaggacacggggatggtggtaaacggcttctccacccgtctgggcggggccagtaaaggccggttcgccaccatgaacttttcctacagcaggaaggatgacccggcggatgtgctggagaatttcacgcggatggcggatgcgctgggggtggagcgtgaccgcatggtggtttcctaccagacccataccaccaatgtgcgcagggtcacccgggaagatgaggggaaaggcgtcatccgtgagcgggattataaggatgtggacggcctgattaccgatgtgccagggattaccctggtaaccttttacgcggactgcgtgcccctgtacctggtggatcaggcccatcgtgcaatcggactcagccattccggctggagggggactgttaagcgcatgggccaggtgaccatggacgccatgaaggaggcctttgggacacggcctgaggatctgacggtctgcatcggccccagcatctgcagggactgctttgaggtaggggaagaggtggcagaggcgtttgcagaagcctttgacgccagatacagggatgaattatacagcgccaatggaaaaccgggcaaataccagctggatctgtggaaggccaatgaaatcatattccgtgaggccggcgtgccaaaagagcagatacataccacgaatatctgcaccatgtgcaacagtgattacctgttttcccaccgcagggtgggggaggagcgggggaacctggcagcctttttaagtatcaggtaactgccgtgagtccattgtggggaaggatgggaatctgtagtcctctcttccctggaaggaaatcagctggctgggtcatggacataccattccctgcggcgcggtgccgggatatgaggcggtcctgctgttggatccggcccagtgccgggtccgcccaggccctgcttttagcggctttatgggagaaccggtcaacctgctgtggatgatgctgcttacgggggacgaatatagaatggcaaaggaaggcggcggggaaagcctcctggagagaaagggggatgacccggcttcatggaacctggtgtagcctggcttttgtaaagtatgaaatacataaaaagatgcacggcccattccatgacaggttgggccgtgcatccttttatccctgcagccagggctgctatctgtttgtaatgataccaggatctgtttgaaaattcattcccggtccagtcacaccggtctatgattataccagtttctggaaatactcatatccgccattctggtatttctgtaccagcttctgaatcttttctgtgggggagagggaggcgctgatggaacggtcatggttcagtgcattgatgatggccgcaatgtacttgctcatatctgcttccagataccagtccctctttaacaggtcgggcgtgcggtaattcaggttggtggtgatgacataatccagataaccctgggtatggaattcatcgaacttctcaaggccgttggtgaagagtccgaaggtgcagcatacgatgaccttctccgccttgcgctcctttaactccttacaggtatccagcatgctctcgccggaagatatcatgtcgtcaatgatcagcacggtttttccttccacggaagaaccaaggaattcgtgggcaacaatggggttgcgtcctccgattacctgggagtagtccctgcgtttgtagaacatgcccatgtcaacgcccaggttgttggccaggtagaccgcccggttcatggcgccctcgtccgggctgatgatcatcaggtgttccttgtcaatctggatgctggagtcatgggtgaagaggcttttgacaaactggtaggttggcatgaagttgtcaaagccgattaacgggattgcattctgtacgcgcgggtcatgggcatcgaaggtaatgatgttctccacgcccatggccgccacttcctcaagacccatggcacagtccagggattcgcgtttgctgcgcttgtgctggcggctttcatataagaaaggcatgattacattcaccctgtgggcgtttgtgcaggcgccgatgatgcgctttaaatcctggaaatggtcatctggcgacatgtggttggtatagccgcttacggtataggggatgctgtagttcattacatccaccatgacgaagacatctgcgccccggacggattctccgataacagccttgccttccccggtaccgaatctggggcagctgcattttaacaggtaagaatccacgtcataaccgcggtagtgaaggtcctccttgcggcgcataagctcttccatgtcattgcgtctgaactgtaccacgtggtcgtttaccttggatgccaggtcctggcagctttccagggcagcgattttcaggggcgcaaccggaagggaatctttaaatacgaaattgttagccatgatagctgtactcctttgtcaaataagtaaataattaccaattttcatatgtctgcatattatcacatatgatttataccattttttatttgaccgggtcaaggggttgcagatatttcctcaaaaaaaacaaaacattttcctaaaaagaacttgtcatttacaaaaaagggcaatattgttattatataagttaaaagactttacaagtaaggacacgtatagtaaaatcaagcggatgcaattttatctgaagggtatggtacgcaatggaatcaggcaggaagccgggcaggaccagctgcgagtgctgcggcaattatgtatatgatgaggataatgattactatatctgcgaagtgaatctggacgaggacgagatgggccgttttttaagtgacaccatgtatgcctgtccttattaccagtctgatgatgagtacaggattgtaaggaaacagatataggatgctttgaaagagaggaaatgacatgagtaaaccagtggtagcgattgtgggcaggcccaatgtgggaaagtccacgctgttcaatgtgatagcaggagataccatttcgattgtaaaggatacgccgggggtgaccagggacaggatttatgcggactgtacctggctggatatgaatttcacactgattgacacgggcgggattgagccggatacaaaggatatcatcctttcccagatgcgggaacaggccgagattgccatctccactgcagatgtaatcatcttcatcgtggatgtgcgccagggcctggtggattcggacgccaaggtggccgacatgctgcgcaaatcccgcaagccggtggtgctggcggtaaacaaggtggacagcatagccaagttcggcaatgacgtatatgagttctacaacctgggtatcggcgaaccggttcccgtatcagctgcgtccaggctgggaatcggcgaccttctggatgaggtggtgaagcattttgacggggagaagatagaggaggaagaggacgaccgcccaaggattgcggttgtgggcaagcccaatgtgggaaaatcctccatcatcaataagctgcttggggagaaccgggtcattgtaagcgacatcgcgggcaccacaagggacgcggtggacacggagattgtgtacaacggcacgccgtatgtgttcatcgacacggctggcctgcgccgcaagagcaggattaaggaagaactggaacgctacagcatcatccgcaccgtgacggcggtggagcgtgcggacatcgtggtggttgtcattgacgccgtcgagggcgtgacggaacaggatgccaagattgcaggtattgcccatgagcgcggcaagggtgtcattgtggccgtgaacaagtgggatgccattgagaagacggataagactatttatgagtataccaataagataaaagaaaccctttccttcatgtcctacgcagagtatatctttatttccgcggcaacgggacagcgtcttccaaaactgttcgaaatgattgacgcggtgcggcagaaccagaacctgcgcgttgccacgggcgtgctgaatgaaatcatgacagaggcagtggccatgcagcagccgccgtctgacaagggaaagaggcttaagatttactatatgacccaggttgcagtgaaaccgcccacatttgtagtctttgtaaatgataaggaactgatgcatttctcttataccaggtatctggaaaaccagatccgcaattcgttcgggtttaagggcacgtccttaaaattccttatccgcgagcgtaagtcaaaggatcaataagcacagcaagggggataatggaatggaacggatcatatgtttagtcatgggatatgtgtttgggctttttcagacgggttatatatatggcaaggtcaaggggattgatatccgccagcatggaagcggcaattcgggaagtaccaatgccctgagggtcatgggggtaagggctggcgcccttgtgtttctgggggatttcctgaaaaccgtgattccctgtttcctggtgcgcatcctgttcgcatcccggccggaatatgtctatgtcctgatcctctatgccggattcggtgtaatcctggggcataattttccgttttatctgaatttcaagggtggaaagggcattgccgcaacagcgggaatcatgttttccctggattggaggctgacggcgctgtgtctggctgcattcatcctgattgtggctgtcaccagatatgtgtcgttgggatcccttgtggtttccaccattttccttatctggaatatcatgatgggacagatgggcgcctatggtctgtcccagacatcaagactagaattttacggggtttctgcggtgatatccatcatggccttctggaggcacagggccaatattgtaaggctggtgcagggcagggagaataagataggcgcgaaaaagcaataaaatatcaaaatggacggtgaagttatggcatcaatcggtgtaattggatcaggtacatgggggacggcgctggcagtgctgcttcatggcaatggacatcaggtggtaatctggtcggcaataccagaggaaataaaggaactgaaggcaacccatgcccacaggaacctgccggaggtggagattccggaggcaatcggttttacggatgatcttgaggaagccatggaggataaggacctgctggtcctggcagtgccttctgtatttgtcaggagcacggccaaaaggatgaaggcatatctccggccgggccaggtcattgccaatgtggccaagggaatcgaggagcacacccttatgaccctgtcacagatcatagaacaggaactgcccgaggcagaggtggcggtcctgtccggcccaagccatgcggaggaggtaagccggggactgcccaccacctgtgtggcgggcgcgcataagaagcatgtggcggaattggtacaggggattttcatgagccaggtgttccgggtgtacacgagtccggatatcctggggattgagctgggcagcgccttaaagaacgtgattgccctggcagccggtatggctgacgggctgggatacggtgataatacaaaggcggccctgattaccagggggattgcggagatatccaggctgggaatcgatatgggaggccggctggaaacctttgcagggcttacgggaatcggtgatctgattgtcacctgtgccagcatgcacagccgcaaccgacgggcaggcatactgattggcaggggatacaccatggaggaagccatggcggaggtgaagatggtggtggaaggcgtctactcagccaaggcagcccttgccctggctgagaagtataacgtatccatgcccattgtcgaacaggtcaatgccatactcttcggcggcatgccggccagggaagccgtgtcggagctgatgctcagggacaaacggattgagaattccggcctggaatgggaagcggaatgacaaatgccatgaaaattaagggagggaacgtctggattggcgcccctcccttaaaaaatgggggcttttgcggtaataagatgaatttgggcacaaattttcggtcattcacgaaaaataacctataatttttatgaaaaggttgacaatccttctgcaactacctataatatagaaagctttataaagaaagtccgcggttattcagacgcggaagggtaaggaaaagcaagaggaggaaaaattatgaaaaagagattatttagtcttggtctggcagtagccatggctgcttctttaacggcatgcggcggttccaacacagcagagacaaccaaggcagcagagactgccgcggcatctaaggatgcggctggtgaaagcagtgagacagaagcagcgtcaggcggcgtgattaagattggcggtatcggacccaccaccggcggcgcagctgtatatggtctggccgtacagcacggggcacagctggcggttgatgagattaacgcggcaggcggtatcaatggctgcacggttgaatttaatttccaggatgacgagcatgacccggagaagtccgtaagtgcttataatacattaaaggactggggaatgcaggcgctgatgggcaccgtgacttccggcccatgtatcgcggttgccgataagacggctgctgacaacatgttccagattaccccatccggttccgccgtggagtgtgcggcgaatcctaacgtgttccgtatctgcttctccgatccggaccagggcgctgcttccgctaagtacataggcgagaacaagctggcatccaagattgccgttatctatgacagctccgatatctattccagcggcatttatgagaagtttgcagaagaggctgctgcccagggtcttgagattgttgcggctgaggcgttcacggctgacagcaacaaggatttctccacccagctgcagaaggctaaggatgcaggcgcagagctggtattcctgccaatctattacacagaggcgtccctgatcttacagcaggctgacaaggccggttttgagacacagttcttcggatgtgacggtatggatggtatccttcaggttgagaattttgacaccagcctggcagagggcctgatgctgctcacaccatttgcagcagatgcaacagatgacctgacggttaactttgtaaagagctacaaggatgcatacaacgaagttcctgtacagttcgcagcagatgcatacgatgcaatctatgccctgaaggcagccatggaagatgccaatgtgaccgctgacatggatgcaagcgctatctgtgacgccctgaaggcttccatgctgaacatcaagttagacggactgaccggcgaaggcatgacatggaccgaggacggtgagccgcacaaggcgccaaaggccgttaaggtagtggacggagcatacgcagccatgtaagcatttcccatccacgggaaagtggacgggctatcacaacacaaaacccaacagagggttgtcactatgacaaccctcttgtttatagtaaggtttcatgatatcataagttacaggattacgctgcttcacagcggtaaatcaaaaaagacttcagacaaagaggtgcaggtatgggctttattaactatttaatcaacggcataagcctgggcagtgtatatgccatcatagctcttggatatacaatggtttacggcattgccaaaatgctgaacttcgctcacggcgatgttattatgattggcagctacgtggtatttgtcacggtcagcaccatggggttcccgccattggtgggtattcttgtggcggtcctggcatgcacgctgctgggtatgaccattgagcggattgcgtataagcctttgcgcggcgcttcacctcttgccgtactgattacggccatcggtgtcagctatctgctgcagaatgtggccctgctcatattcggcgcggatacgaagtcatttacgtccgttgtcaccattcctgccatcaagctggcagacggacagatgaccattacaggtgagaccattgtgaccatccttacctgtatcatcatcatgctcggcttaaccacattcatcaataagtccaaagcaggccaggccatgcttgctgtttctgaggacaggggcgcggcaaccctgatggggattaatgtaaacggcaccattgcccttacctttgcgattggctcagcactggccgccattgcaggtgtgctcctgtgctctgcttacccctcccttaccccgtatacaggctccatgccgggtatcaaagcctttgttgcggccgtgttcggcggcatcggctccatcccgggagcgtttatcggcggaatccttttgggcgtgattgaaatcctttcaaaagcatacatatcctcacagatgtccgatgccatcgtattctctgtgctgatcatcgtactgcttgtcaagcccaccggtattctgggcaagaagattaatgagaaagtgtaggtgccggtatgaagagtaatgcaaaacgtaagacattcatcaataatatgattacatatgggattgtaattgcagcctatatcatcatgcaggtcctggttggcaccggccatgtatccagtctgttaaaggggcttttggttcctttctgtatctatgtgatcatggcggtttccctgaacctgaccgtggggatcctgggtgaactgagcctgggacatgcaggcttcatgtgcgtgggcgcatttgcaggcgccctgttctctaaatgcatgaagggttccatcaatcccaccctgagcctggtgattgccattgtaatcggcgcagcggcggcggctgtgttcggtatgctgattggaatcccggtcctccgcctgaggggggattatcttgcaatcgtgaccctggcctttggcgagatcattaagaatctggtcaatgccatttacctggggcgggatgcctccggtttccacatatcctttaaggattccatgtccctgaagctggaagagggcggggaaatcctcattaagggtgcccagggaatcacgggcacgccccaggcagccacctttaccataggcgtcatcctggtgctcattaccctgttcattgtgatgaacctggttaattcacgtacaggacgcgccatcatggctatccgtgacaaccgtatcgcagcagagtccattggcatcaatatcacgaagtacaagctgctggcattttccatctcagcaggacttgcgggtgttgcaggcgtgctgtatgcccataacctgaccacccttaccgcgcagcccaagaactttggatacaacatgtccatcatgatccttgtgtatgtggtcctggggggcatcggaagcatccgtggttcagtcatagcaacggtcatcctgtacctccttccggaaatgctccggggactcagcaattaccgtatgcttatgtacgcaatcgtactgatcctggccatgcttttcaactccgcaccgcagttcgtgacgatgcgtgaacgcatcatggacaggtttggcaggaaagataagaaaccggcaaaggaggcagcgtaagatggcattacttgaagttaagaatttaagcatttcctttggcggcctcaaggcggttgataatttccagataagcatagataagggacagctctatgggttgattggacccaatggcgccgggaagacaacggtattcaacctgttgaccggtgtttataaaccggatgccggcagcatcgagttaaacggcatcaatgtaacgggaaggaagacaacggagattaaccagtccggcattgccaggacattccagaacatccgcctgtttaaggacctgtccgtgctggacaatgtaaaggcaggactgcacaatcagtacagatattccacggcagcaggtattttccggcttccgcagtactataagacggagaagcagatggatgagaaggccatggagcttttaaaagtattcggtctggatgaagagtgcgattacaaggcatccaaccttccctacggcaagcagagaaagctggagattgccagggcccttgccacaaaaccaaagcttctgcttttagatgaaccggcagcgggcatgaatcccaatgagacagcggagcttatggacaccatccgctttgtacgcgataattttgatatgacaatccttcttattgaacatgacatgaagctggtaagcggcatctgtgaggaactgaccgtgctgaacttcggccaggtactgtgccagggacctaccagcaccgtgcttcacaatccggaagttgtcaaagcatatcttggtgaataggaggagaggatagtatggctatgcttgaagtcagggacctggaagtctattacggcgtgatccaggccataaaaggaatctcctttgatgtggaccagggagaaatcgtggcgctgatcggggccaacggggcaggtaagacaacaaccctgcataccattaccgggctgattaatgcaaaatccggtaagattgtttatgaaggtacggatataaccaaggttcccggatataagctggtgggcatgggaatcgcccatgtgccagagggaagacgtgtgttcgcaaccctcaccgtgcttcagaacctgaagatgggagcttacaccaggaaggataaggaagagatggaagcaacccttaagatggtgtacagccgcttcccgcgcctggaggagcgtaagaaccagcccgcaggaaccctgtccggcggcgagcagcagatgcttgccatgggaagggcgcttatgagccatcccaggatgattgtcatggatgagccttccatgggcctttcccctatctatgtgaatgagatatttgatatcatccagaagattaacggggacggcaccaccgtgctcctggtggagcagaatgccaagaaggccctgtccattgcggataaggcgtatgtgcttgagacagggaacattgcgctcagcggcgatgcaaaagaactgatgaataacgaccaggtgaagaaggcatacctgagcgaataaaggatataaaaaatgaatgaaagggagcgggattgatacaggatcctgctcctttccatattctgaaatccactcttgaaatccctgcatgattgtgctatatataatttacggccggaataaatatttgaaaggagtgaggcgatgcttgacagacaggacttggaaatgatccgtcttgttatgaaggaagagataactgcatcagagatgcgcatggaggaccggatggatgcgcggttcgaggagcaggagaagcggatagacgcgcggtttgcagaacaggagaagcggatagacgcccgttttgaagaacaggagaaacggaacgatgcccgtttcgaagaacaggatgagtgctttggaaaacggatggagatgcggtttgccgaagaacgtgaatggctggagaagcatttggacaagcgttttgctgcgtccgagaacctgatactgggcgaactggaccgtatccatattaagcttcaggatcagctggatgacatgaagcagagactggacgagatgaccgagtattacaggattaagaaactggatgatattaacggggctcttttacttcagatgatacaggaagtggagcgcagagtggaggccctggaaaagaaatcagcatagccagcccgggagtcaaactttggctggcttatatacctatctgtttatcggattgattcaatggatttgatgccgtctgcggcaattctggattatatatcccatattctcactggtaattcaataaaaaaacatccgcaattctttatcatacccataattccctgtgcatatattataaaagcatagcaagggggtatatttatggacaattttaatgtatacaaggatattcaagcgagaacaggcggagagatatacataggcgtggtaggtccggtgcgcacaggtaaatcaacgttcatcaagcggttcatggagcttttggtgcttcctgcaatggaggatgataacctgcgcaatttaagccgtgatgaactgccccagagtgctgccggaaagaccataatgacaacagaacccaagttcatccccaaggaagcagccaagattaatctggccgatgggattgaagccaaggtaaggctgattgactgtgtgggcttcatggtggacggggccgcaggccatgtggaaaacggcgaggaacgcctggtgaagacaccctggtttgattacgacatcccttttacccaggccgcggaactgggaaccaggaaggtcatcaatgaccactccaccataggaatcgtggtgaccacggatggcagcataggggaaataaaacgtcccggatacatagcggctgagaaacagacggttgatgaactgaaaaagcttgggaaaccattcgtggtcctgctcaattccatgaagccctactccgatgagacagccaagctggccaaggaaatgtcggaaggatacggtgtatccgtgcttccggtcaactgcgaacagctgaaaaaggatgatgttttccatatcctggagcgggtattgaaggaattcccggtcacggagatggacttccatattcctaagtggctggaaatccttcctgccacccactggctgaaggcacaggtcatccaggctgccaggggggtcatccagaaggtcagccatatgaaggatgtggccggtgaactgtctggacagaacacggacaccatacgctccatgaatgtaaagaacatgcagatggcggacggacgggtggccgtgcaggtggatatggatgacagctattattaccagatcctcagtgactatgtgggacttcccattgagggggaataccagctgatgcagaccttaagcagcctggccaatatgcagaaggaatacgaaaaggtccagaacgccctgacccaggtacgtcttaagggttatggggtagtgacgccggaacgctctgagattgtcctggatgaaccccaggtcatcaagcatggcaacaagtatggtgtgaagatgaaggcggaagccccctccatcaacctgattaaggcccatatagagacagagattgcgccaatcgtgggcagtgaacagcaggcccaggacctgattgcctacattaaggaaaatgccagggacagcgatgacggaatctggaacaccaacattttcggtaaatccattgagcagattgtggaggatgggattcaggcaaaggtctcacagatgacggaagactgccagcttaagcttcaggataccctgcagaaaatcatcaatgacagcaacggcgggatgatatgcatcattatctgaaatcaacagttacccgtcggtgtgttgaaagcatgacaggtttcaggaaattgtgtaaatatagcgatactatttgcattcataccgagaacatggtatactgtaaccagaattgacagaatatttatgcggcgggactatattatacgcagaggggagaatgcagatgagactaacatttatcggggcggatcatgaggtgactggaagctgtcattttctggaagtaggggaaacaaaggtattaatcgactgtggcatggaacagggaaacaatgtctatcagaacgcggaacttcctgtaagctaccgtgaaatcgactatgtattcctgacccatgcccatatcgaccatgcgggcatgctgccctggatttatgcaagggggttccggggccgggtgatagccacctatgcaaccgttgacctgtgcaatatcatgctgaaggacagcgcccacatacaggagatggaggccgagtggaagaaccgaaaggcgcgccgcgcaggccgcaccgaggtggaggccctttataccatggaggatgccgaagatgtgctgaagcattttgaaggggtggcttacgggcaggaattcaaacttaatgataacctgaccctgcgttttacggatgtggggcatctgctgggatctgcatccatagagatatgggcttgcgagggaagccatactaaaaagattgtattctccggggacatcggcaataagaataagcccctcataagggatccgcagtatattgacgaggcggattatgtggtgatggaatccacctatggcaaccgctaccacaaaaaaggcgtgaaccatgtggagagcctggcccgcatcatccaggagaccctggaccgcagcggcaatgtggtaatccctgcctttgcagtgggacgtacccaggaactgctgtatctgatacggcatatcaaggatgaaaagctggtcaagggacatgacggctttgacgtctatgtggacagcccgctggcagtggaagccacccatgtgtttaaggaaaacatgctggaatgttatgacgatgagacaaagacgctggtggaaaaggggattaaccccattgacttccctgggcttaagctttccattaccagtgaggaatcgaaaaacatcaacttcgatatgacgcccaaggtaatcatatccgcggccggtatgtgcgatgcgggccgtatcaggcatcatctgaagcataatctctggaggccggaatgctccattgtctttgccggataccaggcagaggggaccttggggcgcctgattcaggacggtgcacagaccgtgaagatctttggcgaggagattgatgtaagggcccatattgagaatattgaaggaatcagcgggcatgctgacagggatggcctgcttacatggatatcctcctttgagaaacggccggattatgtgtttgtggtccatggcgatgaggagtcctgcaccgcatttgcggatatgctggatacccagctgaaactgaaagccagggcgcctttttccggttcacagtttgacttaatcaggggatgctggattaaggaagctgagcctgtactgattgagaaagagacggaagccagacgcagggcaacgggtgtctatacacgtcttgtggatgcggggaagcttcttatggatgtgattaaccgtaaccagggaggggccaataaggatttaacacattttacagaacagatactggccctctgcgataaatgggccagataaggacagtgaggacaggagacagtaatacatgagtaaagtacagatttatacggatggttcagccagagggaaccctgacggcccgggaggctatggggtagtgctgcgtttcacggacaataagggacagctgcatgagaagaccctgtctggcggatacgtgcgcacgaccaacaacaggatggagctgatggctgccatcatgggactggagacgctgaaccggccgtgccaggtagagttgtattccgattccaagtacctgacagatgcatttaaccagagatggattgacagctggattgcaaagggatggaaccgcggaaaaagcggtcctgtcaagaatattgacctgtggaaacggcttctgaaagccaaggagcctcatcaggtcacctttatctgggtaaaaggacatgcaggccatccgcagaacgagcgctgcgaccagctggcaacttcggcggctgacggtgatgacctgatggttgatgagggactggaaagctgatttcttacgtatctcttacaatctattactcctttcatctgcatattccctttcctgtttttttgtgataatgtagtgacaagaacacagcagggaagtgtgacgatgaaggataaacgaatatggattgtaattatctgcatcctggtgatagggaccggggtcacccattataccaagtactacgtaaaaagccaggcaacagccatggatacagcagcaacaacggctggcgagatgcctgcaggagcaccttcccctgcatctgcatctgaagtgaaggaagaggaacagaaggcagggaaagccgcagaggtttccgcccccatggacaggagcctcagtgcttccccggcagcaggagccgggccaggcgccgcatatgcttcctcccctatggaagacagggcagaagcccaagccgcggcagaggagactgatgcatcggatgaggacggtgtccaggcggtccagatatattcggaagatgaagtgcctgtggaacagatgcccatatcaccgctgacaggtgcaaaagagactgaatcaaagatgctcctcaccatagattacaggcagcgcctgatggacctggattcgcagatacagaagatgcgcgagcaggagacggattccaatgtctattccatcaaaacctcagctgaaaccgaacttaagatgtgggaaggggaactgaattccatttataatgcactccttgagcttctgccccaggaagatgcggccaggctggctgcagaacagcaggagtggctgaagaccagggagacaaaggctgcagagaacacaggtaaaagcggcggttcggtggaacggattggatatgcggcaaccctggcaagccttaccagggacagggcgtatgagctggctggcagatatgagcaggccaacggccttcctgccccggtggaagaggaaaccacggatgccgtatccgggcagtaggcgctcaccccggttatctgatatgcctggcagggaaagggaatgcataaagtaatggataagcgggaaaaccaatggaaaatccttggttttcccgcttattttgtgaagtgagtcttgataaatatataccaatatggtaaaatgacggttatgtaatttatgatgtgatgatatggaggaagataaagtgaaagaaccacagtaccgcggcgtgaatgaactccgccggatgttccttgaatttttcgagagcaagggccatcttgccatgaagagtttttcccttgttccgcataatgataacagcctgcttttaatcaattccggtatggcccctttgaagccgtacttcaccggacaggagattccgccgagaaaacgcgtgaccacctgccagaagtgcatccgtaccggtgatattgagaatatcggcaagactgccagacatggtactttttttgagatgctgggcaatttctcctttggcgattattttaaacatgaggcaattgcctggacctgggagttcctgacggaagtggtcggcctggatgctgacaggctgtatcccagcgtatacctggaggatgacgaggcgtttgatatctggaacaaggagattggaatcccggctgaacgcatttttaagttcggcaaagaggacaacttctgggagcacggatccggtccatgcggcccctgttccgaggtatactatgacagaggggaacagtatggctgcggcagcccggactgtacggtgggctgtgagtgtgaccgctatatagaagtgtggaacaatgtatttactcagtttgataatgacggacatggccattacacggagctggagcataagaacattgatacaggcatggggctggagcgtctggccgtggtggtccagggcgtggattccctgtttaccgtggacaccaacaaggcccttcttgacagggtttgtgaactgtcccacaccgaataccagaaagaccatgagacagatgtctccctgcgtattgtggcagaccatgtcaagtcctgtaccttcatgatatcggatggaatcatgccttccaatgaaggcagggggtatgtgctccgccgtctgctgcgcagggctgcccgtcatggaaggaagcttgggattgaaggcaggttcctggcagagctttcaaggacagtgattgaactctgcaaggatggatatcctgaactggaagaaaagcaggtcatgatattcaaggtcctgtctgaggaagaggataagtttaacaagaccattgaccagggccttatgattttgggcgagatggaagaggagatgcagaaggagggcagcaggacactgtccgggaccaatgcatttaaactgtacgatacctatggattcccgctggacctgaccaaggaaatcctggaggaaaagggatacggggtggatgaggacggctttgacgctgccatgaaggagcagaaggaaaaagccaggaaggcgcgcaagacaaccaattacatgggcgcggacgtgaccgtttaccagtccattgacccttccatcacaacggaattcgtgggttatgataagctcagcgcggtttcaaggattacggtgctgaccacggaggatgaactggtccaggctcttacggacggacagaagggaaccgtgattgtaggacagaccccattctatggcaccatgggcggccagcagggcgatgtgggtgtgattgtcaatgaaaacggtgaatttaaagtagaagataccatacatctccagggcggcaaggtgggccatgtgggtataatgacaaagggtatgctcaaggtggatgacagcgtgacgctttctgtctgcgggaagaaccgcgcccttatctgtaagaaccacagcgccacccacctgttgcagaaggcgctccgcctggtgctgggggaccatgtggaacaggccggttcctatgtggacgcgggcaggctccgttttgacttcacccacttctcagccatgacgcctgaggaaattaaaaaggtagaggcactggtcaacaaggagattcaggcatcccttccggtggtgactgaaatcatgaccctggaggaggccaagaagacaggtgcaatggccctgttcggtgagaaatacggcgactccgtgcgcgtggttgagatgggggatttctccacagaactctgcggcggcacccatgtggcgaataccaacaatatcgcttccttcaagatcctgtcagaggcaggcattgccgccggtgtaaggcgtattgaagcccttacctcagaaggacttatgaagtattatgaggaaatggaggcaggactccatgaggcagccaaggcagccaagacaacgccggcagcccttacctcaaagatccacgcactgttagatgagattaagtccctgaattctgagaatgagaaattaaagagcaggctggccaatgattcccttggggacgtgatgagccaggtgaaggaagtaaacggcgtcaaggtcctggcgtccagggtatcaggcgtggatatgaacggcctgcgcagcctgggggaccagttaaaggataaattgggagacggcgttgtggtccttgtctccgaacaggacggcaaggtaaacctgatggctactgcaacggatgccgtacagaagaagggagcccatgcaggcaacctgattaaggcaatcgccggtcttgtgggcggcggcggaggcggccgtccgggcatggcccaggcaggcggaaagaacccggcaggcattgaggatgcccttaagaaagcagttgaagtggtggaagaacagacgaaataagtcttatctttaaaaaaatgcaaaataactgcaagaaatatcatttttttcttgacgtacggtatttttatgctataatcatagcagtgctaaaaatacccaaacagttgtattatgcacaattacacaactggagggaggttaggtgtgagcgatgtcaaacgtaattgttaaagataacgagaccttagacagtgctttgcgcagattcaaaagaaactgtgcgaaggctggcattcagcaggaaattcgtaagagagagcattacgagaagccaagcgtaagacgtaagaaaaagtctgaagctgcccgtaagcgtaaattcaactaattcacagcatgcactgcgtgagtctggttgtcagaggtaagtaaaatcagctggctgttatggaaacataacagccagctgtttttgccgtgcgccctgcggcgcacgtttttttagtttttaagttcctgcttttccggtccgggaatcctttatctgctcctgttcacccaggccatatcagtccgcttccttaaggctgcaggaaggcgttgccaccagtgaatagttggtgtggtagataacaaagccgggggctgaaccagccacctttttaatattcttcttctgtatatagtcaatctccaccttatcattatcccgtcccttggaataataggcggccagggcgcctgcttcctcaaacacccggtccggaaggtctgttttcccctcagacttaacaatcacatgggaaccggggattcccttggcgtggaaccaccagtcattgcccgtggcaaccttgaaggtcagttcctcattctggtaattattcttgcccacgtacatatgatatccatcggaagagatataatggaagggcctgctggtaatcctgggcttcttgtcaccggacctgcgtttcttgatataaccgtattccatcagttcctctttaatctggaccaggtcatcctccttaagggcgatatccagggctgaactaatggattccaggtggtcaatctcagcctttgtctcctttgtcaggtcggttaaggcttcataggtacgtttcagcttgttatatttgtcaaaatgcttcttggcattatccttggcagaaagctgggaatccagggggaccgtgatttcctcattggtatagtaattcaggcaccggagggacttctcgccgccttgaagttcatacccataagtattaaggagttccccgtagatacggtatttctcgcgcttctccgtgtcacccagctgctttagctgcagatcgtactttttatagttgcgctccagggctgtctggacaatcctgcgaaggtccgaggatttctgcctgatcctggtcaccgtgtcccgtgacgcataataattttcaagaagcgcgctgatggaggccacatgttccaaatggtaatcagccccttcatagcaggtaaggggaaatgcggcatattccacaggtccatccacgtcatggacaatggccggtgaaaagttaccgtcccgcacatcctccatcaccaggctgaaggtatggtacagatgcaccagctctgcctctgaaagctgattggccgactggtcggaatcaatggaggccaggtggcagatttcctccgccataatggggctgattccggtaaggcggttatacagcgccttctgcacggtcatgggggcattccccatcaggcctgcaaattcctcctgggaaaccgtaaggggattctccttagccacggtctgcggtatgaaatactccctgcccggcagcacctcgcggaccgagctgacctgggccgatacatgtttgatgctgtcgatgatggtcttatcctctttacagaaaataatattactgtgcttacccataatctccacaatcagcttcttccggcacagatcccccatctcatccagatgttccaattcaaactcaataatccgttccagcccgggctggctgatacccacaatccgtgcgctcccgatatgcttgcgcagcagcatgcagaaattcggggcagtcatagggctgggcttattcttatccgtaagataaatcagcggcaggcttgcgctggctgatatctgaagcctgtaattttccttgttattcttgatggcgataagcaactcatccttttccggctgggcaatcttagaaatacgccctccctccagggtatccttaaactcatgcaccagactggcaatggtaattccgtcaaatgccataaaatctcactcctgtcaggcccgatttggcataaagcaaaaaacaaaaccaaaatcacccttatgccacggccattgactataagaataacataaaaaatccaataagaaaaggccaacctacgccagctccccgagcttccccaagctatttcccccatgcatgaagatacagcaatcagaaacacccagtgggtgaggaagggagccggaggagggggatgcatccacaggagtgttagaatcccttaggctgtgggaaccggcgttaagaggcaggcgccctttgtctgagcccaataccaaaatccatgcgatagccaaagcgcgagtttgggcagccggcctcttgtccttagccggtttccagagccttagggattcccgctccgcagccgtatccccctcctccggctcccttcctcacggacggatgcacctccacccgtcatcccatacatccccacccaatcatttccttgacttgaatccccagatgaattataatactatctaactatggataaaagcgaaagagaggcattcgttatgttaaaaagcatgactggtttcggcaggtgcgagaatataaccgatgaatataggatttctgtcgaaatgaaagccgtgaatcacagatatctggacttgagtattaagatgccgaagaagtttaattattttgaagcttccatcaggacccttcttaagaaatacatccagaggggaaaggttgacctgttcatcaactatgaggactatacagaaggcaacatgtgccttaagtacaaccgggcgctggcagctgaatatatggattatttcaacaagatggcagaagaattcagcatacagaacgatgtgaaggtttccacactggccaagttccctgaggtattttccatggagcaggcgccggacgatgaggaacatctgtgggggattctgtcagcggcgcttgaggaggctgcggtgaagttcgtgcagtccagggaggtggaaggagaacatttaaagaatgaccttctgggcaaactggattatatgaccggcctggtggattacattgaagagcgttcaccacagatactgacagagtacagggccaagctggaggccaaggtccaggagctgttaaacggcacagccatagatgagggccggattgcggcggaagttaccatttatgcggataaaatctgcgtggatgaggagacggtacgtctgagaagccatattgagaacacgaggaaggacctgttaagcggcgggagcgttggacgtaagctggatttcattgcccaggagatgaaccgggaagccaacaccatcctttccaagtccagcgacctgtcgatttcggacaaggccattgcccttaagaccgagatagaaaaggtcagggagcagatacagaatatcgaataaaatgcagcacgaaagtcaggagagtacaccatgagccatcagggaatattagtggttgtgtccggtttttccggtgcaggcaagggaacacttatgaaggagctgctgaagcaatacgataactatgcgctgtccgtatcagccaccacaaggcagcccagggaaggcgaaaaggacggggaggattatttctttgtcacaaaggagcatttccagcagatgattgaggagaacagactggtggaatatgcccagtatgtcaatcattattacggaaccccaagggattatgttgagaagaagatggcagaaggcaaggatgtgatcctggagattgaaatccagggcgccctgaaagtcaaaaagcgttttccggacgcgctgcttctctttgtgacgcctcccagtgcagaggaactgcgccgccgtctggttggacgcggcacggagaccattgaggtcattaacgcaaggctgcgccgcgcggcagaggaggcggcaggtatggaggcatatgattatctgctgattaacgatgaaatccagtcctgtgtggagcagatgcatcagctgatccagctccagcacaataagacctcctatcacctggatttcttgagcaggatgcgggaagatttatatcacttggatgacagaaaataaaatataaagattgaaaggggaatgtaatatgttacatccatcatacaccgatttaattgacgtagttaacagcgatatcgagccaggagagcagcctgtggtacagagccgctattccattgtcattgcagcttccagacgtgccagacagatcatcgggggagaagaccccatggtaagcggcgccgcaggcaagaagccgctgtccatagccattgacgaactgtaccaccagaaggtgaaaatccttccggaagaggaaaacccatctgaggaagatgagaaccagaacgcataaaatcataagccgtctcctgtacaccgcagcaggcagggtcattcccggcactgcgggcacagcagagatggcttaaatgttcattaggagtaaatttgacatatggaaaacatgaaattattttgcgtgtccctgggatgcgataagaaccttgtggatacggagaaaatgctgggactgctgggcgggaccggttttacatttacagatgatgagatggaagcggatgtaatcctggtcaacacatgctgctttatcggcgacgccaaggaggaaagtgtgaataccatcctggaagtggcgcgtttaaaggaagaaggggcctgcagggccttgatcgtgacaggctgcctggcccagcgatataagcaggaaatcctggatgagattcctgaggtggatgccatcctgggcaccacgtcctatgaggatgtggctgggattgtgaaacaggtgctggagggcaagggaatcacccatctgaccagcttccatgacctgggggaacttcctgacacccaggcgggacgggtagtgaccacgggcggatattatgcgttcttaaaaatagcggaaggatgtgataagcgctgtacctactgcatcatcccctatctgagggggccttaccgcagtgtgcccatggagcagcttctggaggaagccaggcagctggccagcggcggggtaaaggaactgatcctggtagcccaggagaccaccctttacggcaaggatatctatggtgggaagtcccttccaaagctgctgcatgagctggcgcagattccgggcatccagtggatacggatccagtactgttatccggaagagattacggacgagctgattgaagccatacgctcagaagaaaaggtctgtcattatctggacatcccaatccagcacgccagcaaccggatccttaagcgcatggggcgaaggaccaaccgtgaggaactgacggaacgcattgcgaagctgcgaaaggagataccggatatagcgctgcgcaccaccatgatttccgggttcccgggggagacccaggcagaccatgaggagctgatggactttgtcaatgagatggaatttgaacggctgggggtatttgcctattccgcggaggaggacacccctgcatattcttatccggaccaggtgccccaggaggtgaaggaggaacgcagggatgaaatcatggaactgcagcaggacattgcctttggacactgtgaggatatggtgggacgtatcctgaccgtgctgattgaagggaaggtggtggatgagcctgtctatgtgggaaggacttatatggacgcaccgggtgtggacggacttatatttgtgaatgctgagatggaactgatgtctggcgactttgtaagggtaaaggtgaccggagccgctgaatatgatctgataggagaggtgtacgatgaatctgcccaataaactgacgattgtaagagtgtgtttgattcctttttttgtagctgcactgctgtttgaccatggcaataactataccatgcgtattgttgccaatgtcctgttcatcattgccagccttacggacctgtttgacggcaagattgcccgcaaatacaacatggtcactaactttggcaagttcatggacccccttgcggataagcttctggtgtgttccgcccttatctgcctgattgaactgggacagctccctgcctgggtcgtgattgtgatcatcagccgcgagttcatcatcagcggcttccgtctggtcgcggctgacaacggcgtggtgattgccgccagctactggggcaagttcaagaccaccttccagatgattgcggtcatcctgctgatatttgatatcccggccctgcgcctggttgccaatataaccgtggtgattgcagtggccctgaccatcatctcactggtggactatgtggccaagaattacaggattctcactgagggaggcatgtaggatgacggcggaactgatttcagtgggcaccgaactgctgatggggaacattgtgaacagcaacacccagttcctggcggagaagtgtgcccttcttggatttgatatgtattaccaggtgacagtgggggataattacggacggatgaaggctgtgattgagacagccctcaaacggtcggaccttatcatactgaccgggggcctcggccccacggaagatgacctgacaaaggaagtatgcgctgaggccatgggcatggagctggtggaagacccgcatacaaggaagcatctggaagcattttttgtcaacaatatatacaaggagatacctgataacaattggaagatggctgccgtcccaaagggggcgctggtccttgataaccataacggcatggcaccgggactgatcctggaacgggacaacaagaccgccatcctgctgccggggcctccgggagaactgtaccccatgttcaatgaccaggtgttcccgtggcttcagaagcgccagcagtccgtccttgtatccaggatggtaaaaatctgcggatgcggcgagagccaggtggaggatatgatcctggacctgattgacagccagaccaaccctaccattgcaacgtatgccaagaccgctgaagtgcatctgcgcatcacggccagggctggggacagggaacaggccgaggcgctgattgaaccggtgctggaggaaatcagcaggcggttcaaggagaaaatctataccacggatgagaaggtcagcctggagatggctgtggttgagctgttaaagaagcataagcttaccatgtcaacggctgaatcctgtacaggaggcatggttgcagctaagctggtcaatgtttccggcgtgtcccaggtgttcatgcagggcatggtcacctattccaatgaagccaagatgcgtcttctgggagtgaaggaagagacacttagggcttacggggcagtcagcgcgcagacagccgctgagatggcggcaggaggcgctgccatgagccggaccgatgtctgcgtggccatcacaggccttgccgggccggacggcggcacggataagaaacaggtgggacttgtatatatggcatgctgtcttaagggaaaggtaacggtgcaggaatatcattttaagggaaacagggataagatacgggaacaatccatgatgaaggcccttgatctggtgcgtctgtgtatattagaacagggagattgttgacattgcagacaaaaagaatgaaacgacagctttcagcggcctgccattattcctatacacggctggccctgaattattatatgtattatgagacttcgctggaggactcattactggacaacaggctggagccgcttaacgcggcttttcacggcctgctgcggggattcctggatggaacctgcccagaggacgccctggaggaactgaggaaccaggtggcggcggagatggagacagccactgcctataccgatgcattccaggcatacgaatatgtgctgaaccggctggaggggaggtttgcgcctcagccagtgggaaatatggcgggggaagaccacgatgaagccatgacggaacgcatcatgggctatatcacggattcgcaggatgccatgacggtgaatgaacggatccgttctgtccttgggcagcttccggtccgtctgaccaggaataaattcttttcactggtggaggaagggctttcggtataccgcggcagtaccagggaaagcctggatgatatgttctatatcctgcgctccgaggccctgctgtatgttcctgccgatatggtgaccggttacgaggagctgcattccatcctggaggagttaaggacagcggactaccggtccatgacaccggaatcctaccggcaccttacggatgagatgaagcgggccggccatatgctgatggacgacacggcagagctgatgcttctgatggagctggtgaatgacctgtatgtgctttttatctccagggacagcgccatgatggaggtttccgaagaacagtgcctgaaccggatcctttcaggaatcctgtctttatttgaggcgggaacggatgcacctatcccggatgggattacagggcttttggacaggctggaaggacgccaggaagcttattttgaacagtggatggaggacgggctttcgtccggtgaactgagggatataaaaggccaggagggcgaagcctcaaagctatataaggtggagatgctcctgtcaggaagttccttcatgtcccttgtgtctgccggacaggagtcaggggagcttgtggaccaggcaatgctttcagcagcagccagccggttctttgaagagttttcctctgcctttgaggggcagccaagagtgctggtgcgtgccgtcatggccaaggtcctttccagccttccggtattcttccagtcgctggatgaggtacgggaatatatcaggaacagtctggaaagctgtacggattacatggaaaaggcaattaccatgaagctgatcacagacatgatggagcaggatgacctggatccggatgatatattttaggcgcattgattaaatgtgacaggagagatgaaggcatgcgctggtggaagcatttatacatgggtgacagggctttaaagaacagggccaaagtccttatgggaatccgtgagggaaagacaaccccggacatatatgtgattactcttcctgagagtgggaatcatatacttgacatacgtcctgtcctgctgctgacggaaaaggaacgggaagatgacagtttccttattctgggggtggcaaaagggtatggggaagccggtgaggtggtcaggtccatggtagacgacatgtaccgcgccacaggggcatttgactggaatgcatacatgggatatctggacgccgcagacagacgggatgatatttaaggagggaaaatgatccatattctgcttatgatattaaaaataatcggaatcatccttctggtcatcctgggaatcctgctggtgctcatacttgccgtactgttcgttccggtccggtataaggctgatttttcctggcacggggagccggatctgtccctgaaggccagctggtttttgcatctgctttccttccgcgcgatttatacgaaggagggcctgaagttcgtggtcagggtcctgggcatcaacctgttaaggaagcatgacagggatgccttaaaggacgcggcggatgcggtgaaagacgggacggaggatgtactgggcaaggaggaacagaccctgtatgatgaactggaggaggacgaggccaatttcaggaaatcagcgcaggagcggaaggcttcgggcggatacgtggaagcggatgaaggaaatacatccgggggaacacaatccgaaggaaccaaggtcccggataatccggagacggacggggagaaggcgttcgagaaggatgctgcacctgcttttggaaaacttctgtcccttcccgggcggattaagtcccgggtaaaggccctgtgggagaaacttaggttttcttttacccgcatccgtgataagctaaaagggatgcaggcgtttgcgctggacaagaaggcatggctggaggatgagaagaaccaggccagccttaagctgctttacaggcaggtgaaacggctgattgcccatatctggccgcgaaagggtaagggaagcgtcacattcggctttgacgacccctataccacgggacaggtgcttcaggccgtaagcctgatttatccgttctttcataaacagcttgccgtataccctgtgtttgatgacaaggtattggatgcagagggtagttttaagggcagggtacgtctggcctatcctttgtggctggtatttcaggtgttcatggataaacatacccgcaggatgatccgcggttttataaaataaaagagaagaggacatactatggcagagaatcagttcacatctacaatagaaacattattcaagggcatggaccagtttgtcaccaccaagaccgtggtgggagagcctgtgcaggttggagagaccatcattgtccccctcattgacgtaacctgcggaatggcggccggagcatttgcagagggcgcaagacagaagcagaagggcggaggaggaatgagcgccaagatgagccccagcgctgtccttgtaatccagaacggggtcaccaagttagtcaatgtgaagaaccaggatgccatcacaaaggtgattgacatggctccggacttcatcaataagttcatgggcggcaagccggcggtgtcggatgagaccgtgcaggctgcaaaggacactgcatctgcctatgatacgggtaaaaccgaacacatggatataaagtgactgaaggaaatggatccggcaggtaaaggcaggtaaaataagcggcaaaggtaatgaatcccggatttctgcatatgatgaagtatagcttgttgcagaatgggggatatgattaagatatgagaagaatatgcggtcttatgctgttctgcttcggatttgggatggcagtgctgctctttattccggagacaatctttactttcctgttcgttatcggctgtcttgtattgggatataatctcttttgctgttgatggagcggttcgaagaggaagtaagataggtatacagggccatcctgcagtatctagtactgcagggtggctttttggcgcggaagccctttttataaacaaattcttttataaacaattaaagaaggcattgtaaaagctattaagcttcacaatgccctcagacgctacccggattctgtttcattaagccctctctacaaggcctgaacgcaagcaggaagtacatacgtacattctctgggttccaccgttaaccttgactttaacggacttaacattagctttccacatcttgttggatcttctatgggaatggctcactttgttaccgaaatgagctgccttttcacagattacacacttagccatactattgcacctccttagcacgttacttgaattcttccattaagaaaaatccacaacaaatgtatgataccagaaagtgataaaatttgcaagtgaaaaaacaaaaatttatttctttttttcagaaaatagtgtatactgtctctagtaaatgaatggaggcatgtgtatgaagggaagaatcagcaataagatgggcgaaatacagattaacccggacgtgattgctttatatgcaggaaccatagcggtagagtgttttggcattgtcgggatggcggcagtcagtatgaaggacgggctggtcaaactgcttaaaagagagagcctgacccatggaattaatgtggttattaatgataacaggatatcctttgattttcatgtaatcgtatcctatggggtcagcatatccgcagtatctgacaacttaatcgaaagcgtgaaatatagagtagaggaattcaccggcatggaggttgagaaaatcaacatctttgtggaaggtgtgagagtgattgattaggaggaagtaacttgtgggtataagtacaattgatgccgggaaattaaagaacgccttcctggcaggagcaaaaggcctggaggccaagaaagactggattaacgaactgaatgtgttccctgtacctgacggggacacggggacgaatatgacgcttacgatcatggcggccgcaagggaagtggcagaactggagaatccgaccatggaccagctggcaaaggccatttcctcaggttccctaagaggggccaggggtaattcgggggttatcctttcacagctattaagaggctttacaaaggaaataaaatccgtaacagagattgataccacaaccctggccaacgccatggtgagggggactgaaacagcatacaaggctgtcatgaagcccaaggaaggaaccatactgacggttgcaaagggtatgtcggataaggcccttgagatggcatccaagacagatgatatagaggaatttgcaagggaagtcattgcttacggcgactatgtactggaccagacgccggagatgcttcccgtattaaagcaggcaggcgtggtggattccggcggccagggcctgatgcaggtggtgaaaggcgcatttgacggactcacaggcaggatggccgatgtttcgctggatgcggttcctgagcagaagggaccggcggcgcagaagccccaggcagcctccctgacggatattgacacggcggatatcaagtttggatactgcacggaattcatcatcaatctggaaaaggattattcagaccaggatgaaaaccagttaaagtcctatctggaatccatcggtgactcacttgtggttgtgtcggatgacgagattgtgaaggtacacgtgcacaccaaccatccggggcttgcatttgagaaagccctgacctacggttccctgtcccgcatgaaggttgacaacatgagggaggagcatcaggagcgtatcatcaaggactccgaacggctggcaagggaacaggcggccgggaatgacggggatgtggggcagccttcaaacgagcgcaagacatacggattcatagcagtgtcaagcggcgacggcctcagtgagatatttaagggaatcggtgcggattacctgattgaaggggggcagaccatgaaccccagcacggaagatatgctcaacgccatcgataaggtgaacgcagacaatattttcatactccccaataacaagaacatcatcatggcggcccagcaggcaagggacctgactgaagataagaacattatcgtcattccatccaaaacagtgccccagggaatcaccgcccttgtaaacttcatgcctgacctgtcagccgaggataacctggctgccatgacagaggagatggacaatgtaaagacggcccagataacctatgcggtacgcaccaccaatatcgacggaatggagatagaggaaggggatatcatggctatcggggaccatgggatgctggcagccggcaagtccgtggaacgggtggcaatggatgccttaaagtgcatgctggatgatgactgcgaactggtcaccgtgtattatggaagcgatgtggttgagaatgcggcaaaagccctggtgagccaggctgagcagatgtatccggataaggagattgaacttcagtacggagggcagcccatttattattatatgatttccgcggaataaagacagcggagtaaagacaaaggaatgataagaggacagaatatatggcaaggtggacgagagatgaaaggctggaccagccccaggactttgtccggttcatgatggaggattatctgaataaaggcgggtttaaaaagaaaatccataaaggtgaggaagtgtggcaggagggtgagggattcctggcctccgcacggttcatccggtacgaatattccgatggcctgttccatctggaggcatggattggcaagcgcagggagaatgccctgaagggatttgtgggcgcgctgcccaagaagatgttcagggaaagcctggaggagcttatccggctcctgcaccagccgttaccggaggcccgggaaggggaagccggaagggtggtcaccatacaggtgcctgaccatgcaaagtatgcggtaccggccatggttgtttccatcgtggggattatagtggggctcatgctgtcgcctttaggaggaatccttcttgggagcgtggggatttcacttgggcagaatgccaggaattccagtaagggcaatattgccagggcctccgtcatcctggggacagtggccgtgatagccgcccttgtgggctatatacttaatatgatatttttgttttcattttttaaataaagagaggagagatgatatatgaatgaagagatgatgaaccggtcctatgaagtacaggtagagagggagtcccttggacgctacacggccaagacctttggctggatgtttgccggccttctgattacctttgcggttgcggtgggcggattgtttacaggcgccatagcatatgtgtactccattccttactggtactatatcctgtttgcagctgaaatcggcgtggtcctgttcctttcagccaggattgagaagatgtccgtgggattggcaaggaccatgtttttcctgtatgccgtattgaacggacttgtgttctgcgcatacctgattatttttgacctgaccatcctgtggatggtattcgggatcacttccgtgttctttggaatcatggcccttattggctggtttgggaatatcaactttgcaaagctccgtccattcatggtcggcggattgattttcctggtgttctactggctgctggccatgtttatcgatttgagtgcatttgaaacaggggtatccatgttcggcattttcctgttcctgattttcactgcctatgatacgaagaaaatccaggcatattatgagtactatggccaggttccggagatggctgccaaggcttccattttctctgcgcttcagctttacctggatttcatcaacctgttcatctatctgctgcgcgtgctgggccgcaggaaataaacaatcactaaaatctattgccggtttctttaaggccctgacagtgtattctgtcagggcctgatgcaatttaatctagaacgtgtttgaaaattcattcccgccatctgcacgccccactttgcggcatatttggtcccgattcagtcaacgtagcccgctacgcctccctcatcgggaccaaatctcccacaaagtgtgacgcacagctgacggaaagcaattttcaaacacgctctagccaaaatcaggaaatgattgtataattcaatcattgaatcaccacaatgaaaggggaacacatatgttaatcggagcattggaagcaggcggaaccaagatggtgtgtgccattggaaaagaggacggaacgattctggagcagatatcaatcccaaccaccacacccgaggagaccataccgaagctgattgggtattttcaggataaggagattgaggcgttgggaatcggggcctttgggccggtggatgtgaatacggagtccgggacctttggatatatcctggattcaccaaagctggcatggagacacaaggacctggtgggaggcctgaaaaaggcccttggcataccggtgggtcttgacacggatgtgaacggttcctgtctgggtgaagtgacttacggctgcgccaagggccttgacagtgtcatctatatcaccattggaaccggagtgggagtgggcgtctgggtgaacggcggcctgcttcacggcatgctgcatccggaaggagggcatattttcctgccgcgccacctggaggacccggacggaggcatctgcccttatcacaggaactgcctggaaggctttgccagcgggcctgccattgaggccagatggggcaaaaaggcagtggaactggtggacatgcctgaggtctgggaacttgaaagctactacatcgcccaggccctggtggattatatcctggtgctgtccccacagaagatcatcctgggcggaggcgtcatgcatcaggagcagctgttccccatgatccgggccaaggtgcttgagatgttaaacggatatattaatacggaggagctgggggatatggacaattacattgttccggccagccttaaggataatcagggcatcatgggatgcatcaagcttggactcaatgcccttgaggcatcacgatagtttttccaggaggtatattgctgcatgttaaacggacagccggtccactcattaaaggggattggtgagaagacaggtaaattatttgaaaagcttggcgttttcagcattgacgacctgctttcctattatccaagggcttacgatacgtatgaggccccggtgagcatcggccagctgaaggaccagacagtgatggccgtggagtcggtgcttctaaagggcgctaacctggtccgtttgaaccatatccagattgtgtctgtacagttaaaggatatcacaggatccctgcaggtgtcctggtataacatgccttatatgcgcgccaacctgaaatcaggggagacttatgtattccggggccgggtggtgagaaagcgtggaaggctggtcatggaacaacccgaggtatttacgcccgaggcgtatgaggcggtggcccattccatgcagccggtctatggacagaccagaggactcagcaataagacgattgtaaaggcacagcagcaggcccttgaggtgcgcaggctggaacgggaatatatgcctgccggactcagaaggaagtatgaactggcggaaatcaattatgccattgaacacatccatttcccggcagaccgcacggaactgctgtttgccaggaaacgccttgtgtttgacgagttcttcatgttcctggtgggcgtaaggcggatgaaggaacacagggaggataagcattccccctatgtggtcaaacgggtgcaggaggccaaggcccttaaatcctccctgccctacgccctcacaggagcccaggaacgtgccctggaggaagtgtacagggacatggagggcgggctggtgatgaaccgcctgattcagggcgatgtgggttccggtaagaccatcattgcgattctggccctggtccaggccgcatataatggatatcagggcgccctcatggtgcccacggaggtactggcaaggcagcattatgaatccatgatttccctttttgaggcccatggcatcacgaaggttccggtgcttgtgaccggatccatgactgctaaggaaaagcgcctggcctatggtaaaatagctggccacgaagcagatatcataatcgggacccatgcccttatccaggaaaaggtggtttatgacaatctggccctggtcattacggatgagcagcaccggttcggggtgggacagagggaacttctcagcacaaagggacaggagccccatgtgcttgtcatgagcgcgacgcccatcccaaggaccctggccatcatcatttatggggatttggacatctccgtcattgatgaacttccccagggccgccaggccatcaggaactgtgtggtggacccgggataccgtccaaaggcatattcctttatccagaaacaggtggagatggggcaccaggcctacatcatctgccccatggtggaggccagcgagatgattgaggccgagaatgtgctggattacacaaagtccctgcggacagagcttccctcccaaatcgcggtggaataccttcacgggaagatgaaggctaaggaaaaaaatgcaatcatggaacggtttgcagcaggagggatacaggtactggtatccaccacggtcattgaggtgggcgtcaacgtacccaatgccacggtgatgatgatagaaaatgcagaacgcttcggccttgcccagctccaccagctcaggggacgtgtgggacgtgggaaagcccagtcctactgcatcatggtcaactgctcccatgacaaggatacgggggaacgcctggacatcctgaaccgttccaatgatggtttttatattgcgtcagaggaccttaagctgagagggccgggggatatctttggcctcaggcagagcggggacatggaatttaagctggctgatatttttacagatgccaatatccttaaacgggtatcagaggaggtggacctgcttctggataaggatcctcagctggagctggaggaacacagggagctgaagcggaaaattgaggattatctgggtacgaattacgaaaagctgaatctataaaggatgcttaagaagagccaaggtatgccggcacataggaatgaaaggagaaatgcaggatgaacgaaacaatgaacgccatacttaccagaagaagcacaaggaaattcctgaacaaacccataccggagcaggagctgcagcagatcatacaggccgcgcttcacgcgcccagcggcatgggcaggcagacatggcagtttacagcggtaaaaaacagggagaaaatccaggaactggctgctgtgatcagaaaagtccttaagagggacggttacgatatgtaccagccggaggtcatcatcattccaagcaatgaccgtgaaagcccctttggacgggaggatgacgcctgcgccatggaaaatatattcctggcagcccattccatgggtatcggctctgtttggatcaaccagcttcagggaatctgcgacgagccatccgtgcgtcaggtactcacatcctttggaatacctgaaaaccatgtggtttatggattggccgcattgggatatgcggatgacgccaaggctgaaaaggaacggattggcaaggttgtgattgtggattaggatataagcaatgaaataaaatgaaagtccccagaccgtgtattcacatagcctggggactttctgctgtttccagcaaggttcagatcttacttcttaaaaccttcaggaccggaggatttatttacctgccagctgacgctcgtaagactcaatcatcttcttaaccatataaccgcctacggaaccattctgtgcagaagtcaggttaccgttgtatccgttggttaacggaacaccgatttcgttggcaacctccatcttgaatctgtccattgcttcctttgcttctggtacgtttgttctgttagaattgttagacataataaaacgcctccttaaaatttatttgccgcttttgtttgagttgtgtgcggcttgttttgtgctacaatcctattatgtgatgattcaaaaataataaactagaaggtttttcgttttttggctaattttgggagaacggttttacatggaccatggatacgaatgaacaatgttcattgacagcttcattttaaagtgctatgctgatagtatcttccgatatccgttatattaatataggactggatttgaggatgaggatgattgttaacaggaaggaagtgaaagggatggagcgcaggacggccaggatatccaaggaaccggaagtacgcaggcaggagatattggatacggccatgaaggtctttatggaaaaaggatatgaggcggccaccatgagggatattgcggcagccatgcatgtggtgccgggattgtgctaccgttacttcgaatctaagcaggctttatatgacgcggttgtgcaacagtatgtgagggacatcacagcgcccatgattcaggtgctggaagaggaggatgacacactggatggattcctggacaggatgcagggacttttctgcgaaatggacggaagggaaaaatatcacctgttctttcataagaaggaaaaccacagcctccaccagcttttgtccgctgatttgtgtgaggcgctgaaaccatatatggaaaaaaagctttacaaaatgaaggaaaaaggactgacggacgcggcgtgcatacccatggcggcatccttcctgctgtacggggcatcgcctgtgattctggatgacgggtattcaacggaggacaaggcggatggcatacgcagtttcatggaatgggtactgaaatcgcggtagacatcggaaggtttttgaaagggatgaaaggaaattcccgcatttaatccatgcatttgcggggattttttatagagaacgaatgaacaatgttcattggaacggcgggatgatgtatggtaatgagtgtataacagcagccgatacatatgggggtaaaacagcagtcggtacatatgagggaaaaatagcggccgatataaggaggaacaggatatgatacaggacaggaccatatcagataagacaaaagcatatgcggtcattacaggcgcaaccagcggcctggggctggcatatgcaaagtggtttgccggaaaagggtttgatttaatcattacaggcagaagacgggatatcatcgaaacaagggcaggggaaatccgggaaacatacggatgcagggtggacattgtactgacggacctggcagaggaagcgggagttcaggaactgattgcccggatggatggaaaacctgtggacgtgctggtgaacaatgcaggctttggccttggactggagtttgcggatttggatgtcaaagacataagacgtctgattttccttcagacctctgcggttgcagaacttacctattccgtcctgcagggcatgaagaggggacatcacggaaccatcattaacatatcatcggacggcgcctttgcccctcttccaaggaacgttacatatgccgcggccaagcgttttctcgtaacctttaccgaaggacttcacatggaactggccgggaccggcgtacaggtgcaggcggtgtgtcccggatttattgattcggatttccatgagagtgcagggatgcacgtggataaggggagaaaaggaatgtttgcatttaagaagccggaagcagtggtggaagaggccatgaaggattttgaaaagggaaatgtggtctccgtgccggacctgccgggaaagttcataaaaatcctggcggatttccttcctaaaaaggcatattacaggttagcaggcggatttatgaagaaaatcctataaaatcttccgggatatagtatgccttggcaggttgcaaccctgtccaaggtgtgatacaataaaaaatcataaaacagcagcggaatgatagcatttccggaatcctgaacggatccggccgggcagcgagtcgctgtcaggaacatcatgatagtatggccgaaagaccgtaatctgctccaatgtacaactgcacattccatgtgcacacgcctgcggcttgtacatctgcgcatcttacggaatccctttttgtatcatccgctgctgttttgtgctgtttataatggacattcatatgaggaaaataaaatgggtgaaccggatttatggaaatactgtacggctggacactgcagggaaatgatcctgtccctccgcctcctggaaggggaggaatggacggatgggaggatcctttcctgtctttacgcaatcagcaatcatgcggagaaacattacaggaaacacaagcttgtgaaaaaggacgggggcgtgcggcatatcatggcgcctgaccctgttcttaagactgtccagaggaacatcctgcaccatgtgctggaaggtctggagatttccccctgcgccacggcttatcacaaaggcgcatcggtccggttgaatgccgcctcccatatggataagccagtggtgttgaagctggatataaaggatttctttggaagcattacctttcccatggtgcatcagggcgccttcaacagccggtacttccctgttcccgtgggaacgctccttacctccctgtgctgctgccaggaccgcctcccccagggttcccctgcgtccgcagccatatccaacctggtgatgaggccttttgatacgtatatggacggctggtgcagggacagggggattgtttataccaggtactgtgacgatatgacattttcaggggatttcagtgcttccatggtgtggggcaaggccaatggatttttagggtccataggctttgaacttaataaatccaaaacaaaaatccttacccgtcatgtgcgccagaccgtgacaggaatggtggtcaatgataaggtccaggttccccttccctacaggagggcgctcaggcaggaggtccactactgcctgaaatacggggtaagggaacatttaaggcataggggcgaaaacggatatctggccatgggggaagagggggaattaaggtacctgcagtccctgtgcggcaggataggtttcgtgctgtcggcagacccggaggatgaatggttcagggatgcggcagatgcagtgaccggaaatattaagacttacttaaagtaatccgccataacctgtgttatactgaaaaacagcatgatataggaggaaaaacaggatggattacaggatacttggagagacactgccggttgttgaggtcaggctcaatgccggggaggccatgtacacacagtccggcggcatggcgtggatgagcgagggcctgaccctggattcaaatataaaaggcgggctgatgaaggggataggaaggatgtttacaggggaatccctgttcatggccacctatacggctgtcaggccggattgtatcattgcgtttgcatccacggttccgggcaggatactgccggtggatatgtcaaggaccagccttatatgccagaagggggcattcctctgcgcccagcccacggttgaggtgagcacggtgtttacaaaaaagctttccgccggtttctttggaggggaaggcttcatactccagcagctgaagggcagcggtatggcattcctggaagtggacggcgatgtggttgagaagaccctggcgccgggcgaggtgatgaaagtggatacgggtaatgtttttgcctttgaacccacggtgtcttacgagattgagacaatcaagggagtgaagaacatgctgttcggcggggaaggcctgtttcttaccagacttacaggacctggcaagatatatatgcagaccatgaacattgccgaattcacgggcaggattgcccagggcctgccaacctcaaactaagatgggaaccacccttaaggtattgaaaaaaatgctaaaaaatccttaaaaccccttgtatatctggaattttcatattatacttgtttggaatgaaatttgctgcggattagcagtatggataaacaggagcattgaatgagagtaatcgcaggcagcgccagaaggctgcttttaaagacagtggacgggatggataccagacccaccacggatagaataaaagaaacattgtttaatatgctgcagccccagataccgggctgtcagtttttagacctcttttccggcagcggtgcaatcggaatagaggctttaagccgtggcgcggacctggcagtgatgatagagaacaatccccaggccgtagcctgtatccgggagaacctgggaaccaccaggctggaggaacgggccgtggtcatggcatgtgacgtgctgacaggccttaagcggctggagggacataactacaggtttgacctggtgttcatggacccgccctatcatcatggatatgaggagcaggtgcttggatatctggcccattcaccgatggtatcggatgaaaccgtctttgtcatagaggcgtccagggaaacggatttcggatggcttgaggaaaaaggataccacatgataaaaagcaaggagtacaagaccaacaagcatgtgtttgctggcaggggagaatagatgaagatagctgtttatccgggcagttttgacccggttacattagggcattacgatattattgagcgcacctccaagatatttgacaaggtcatactgggagtattgaataacagggcaaaatccccgttgttttctgcgggagaacgtgttaatatgttaaaggaagtgactgcttcccttcccaatgtggaggtgcagtcctttgagggtttattgattgattttgtacgccagaatggcgcggccatcattgtaaggggcctgcgggccatcacggattttgaatacgaacttcagctggcccagaccaaccgggtgattgcgcctgaagttgataccatatttttgaccacgaaccttaagtattcttacttgagttccagcattgtaaaagagattgcggaatacgacggggatatcagcgaattccttcatccggccattgccgcccgcgtgagggagaaactgaaggagagacgctagtactgtgcttatacggcccggtatgcggcatttgtctgaggatggttctttatcaggataaggagaagaagtaatatgatgagtagaattgagcagttaatcagcgagattgaagaatatattgacagttgtaaattccaggcattatccaacagtaagattgttgttaataaagaagaattggaagagctgctggtagagctccgtctccggatcccggatgagattaagaagtaccagaagatcatcagccagcaggatacgattctgggagaagcccaggcccaggcagatgccatgctggaggacgccaagaaacaggcggattccatgatggcccaggtcagtgaacagacctcggagatgattaatgaacatgagatcatgcagcaggcttacgcccatgcggaccaggtggtggaacaggccagcatccaggcccaggccattgtggatgctgccgtgaatgatgccaacaatatcagacagagttccatccagtatacggatgacatgctgcgcagccttcagaccatcatcaaccacaccatggaaggggccaagggccgttttgatgcgttcatgacctccatgcagtccagctatgacatcgtatcctccaaccgcaacgagctgtcagggggaattgtccgtcaggaagagcaggagatgcagcaggaaccggaccaggaacagatgtagtacaggcatccgaccatcttcccttatcagcgcatggccagtacataaaacaggataatggataatgcgctgtggatcagcttccatagcatatagtgccggatggagagtccggcattttttaatacgctctttgtctggaagatgccggacaggccgccaaaggcagcagagccgatgataagcattgcgccggacattccgggcacactgtgggcaatggcctgtatgccggtggtgatttccacggctcccaaaagggcagggcgcaaaaggggaggcatggcaaaaggaaatacggtgaggtacagggcaagtatggaaaagagcatgatgtatccgccgattttcaccatggtctcaaagcagcccatcatatggtcatcaaaggaaaagggatgattagctgattcggtattatccggtatgggataaggattctttttgtagtgatagcatttccttgctaatatggatatgggaaggacgggaaggtacagggccgcagcaaccgcccatatgggacaggaggccgcaatacccggaatcacccggatctgcgccagcacgtagccaaggacaaacatggggctgggatggttgctgatggccagtaggtattgcccctcctcatccggaatccgcccgctgtccatgaactcgctggtggtcttggcgcccatgggatatccgcataaaaggccgctcatcaggcagaagcttccctggtccgaaagctgtaatacctttgaaaggactggtttaaaggggcctgtgagtatgtggatggcgttaagggcaacaatcacgccggagcatatcatgaatgggagaagggtgggtaggaccacattgccccagagaaggatgccctgtctcgcgccctccagtgcaagtcccggattgaacagaagcatgagcaggcataggacggacagatagcctaagatggattttttcataagcacctgaatacaatgatttatacaatatattgtaaagggtggcgggctatgcctttgattctcatattactgctggcagtgttccagtgttccattaccaattacctgatcatgaatcctgattattaccagcttggcccctatacctgggaaagcggggaattcaggtcaatgaagctgggaaccatgctggcggagaagaaggccattgattatgacatgcttaccacacttatgatagagcacgattatgacctgaccggggtggaggacagctcctacagcaatacgctccttatggctgccaggcccgctgattacaggaagctgcggcaggcatatgagaccgtgatgggggaccttaagtattttccggtgccgttaagctctgataagggaacgccggacgtggtctatgaaaatggatggctggaggggcgcagttaccggacggacggcgaaagccagggccagcgccaccatgagggctgcgatatcatgggttccaaaatgcccaggggatattatccggttgtcagtatgagcgacgggattgtggagcggattggatggctggagatggggggatggcgcatcgggatccgaagcccgggcggggcatatctttactatgcccatctgtacggttatgccagggattttaaggaaggggaccaggtgaaggccggggaactgctgggctatatgggggacactggatacgggaagacggaaggcactaccgggaattttgatgtgcacctccatcttggcatctatatcaagacggaccatctggaggaaatgagcgtgaatccgtactggattctccggtatctggaaaaacggcggctgacatttacatattagagtggcctggccaggtgaattgtgatatgataagtaggattataggatggatgaggtaaaaggatgacggatgtaaaacagctcccaaaggaattcctggcagaaatgaagctgcttctgggggatgaatacgacaggtatcttaagagctttgaggaaggctttcagccgggactcagggttaatacattaaagacggagccttcacggctgagggcaatggtcccctggaatctggagccggtgccgtggacggagaacgggttctactacggcagtgaagcaggggcagatggaggcccgcggccgtccaagcatccggcttattactgcggtctctattatctccaggaacccagcgccatgaccccggccgccatgcttccggtaaagccgggggaccgggtcctggacctttgtgcggcgccgggcggcaagagcacggaactgggagccaggctgaagggccgggggatgctggtgtccaacgatatcagctattccagggcaagggcgcttcttaagaacctggaactggccggggtccctaatatctgcgtcacaagcgaaagcccggaaaagctggcagaagtgtggccggaattttttgacaaaatcctggtggatgcgccctgttccggggaagggatgttccgccgggatgaggacatggtgaaggactgggcctccagtggaccctcatactacgcgcccatccagcgccagatcctgggccaggcggtccggatgttaaagccgggcggaatgctgctttattccacctgcaccttttcacggaccgaggatgaggggaacattgagtatgtactggaacattatccgcagatggagctgtgcatgcttgatctgtcagccgtacccggcgcagtggatggaatcgggcttaagggctgtttgcggctctttccccacaggctgaagggagagggacatttccttgccctgctgagaaagaagaaaacggatgtggacatgcccgcggaatgcaggcggaaaaacacgaaagccttaaagtccctgaaacgccaggacgatctggtccgtttcatggaatccctgtccctcaagctggatgaggaacggattgtgcttcatcaggaccatgtgtattatctgccggaggggctggagtggaacctgcccctgcggttcctgcgcacaggactgttgcttggggaactgaaaaagggcaggttcgagccgtcccaggccctggccatggcccttaaggcggaccagtttgatacggttgtccgtctgggacatgaggatgaacgggtggtgcgttacctgaaaggggagacagtggagttatcagaggaagaaggccctgtaaagggctggtgcctggtggccatggaagactatcccatgggctgggccaagggcactggaatgagccttaagaataaatactatcccggctggcggtggcagtaggatgccggatggctcctgcagcggcaccaggattggccgggcggttccgtctgggtcgggatgtgggttttgggaagaatggtgatatgagtggcagataagaaaaaacagaagacaggcccgatgaggctggataaattcctgggagagatgggatacggcacccgcacccagataaaagagatggtgaggaaaggacgtgtccaggtcaatggacaggtgataaaggcccccgagtccaaactggcgccggagacagaccaggtcatggtggaccagtcggtggtgggatatgccaggatggaatattatatgcttaataagccaaaggacgtggtgagcgccacaacggacagccgttatccgaccgtggtggggctgattggtgatgcgctgcgaaaggacctttttccggtgggccgcctggatgtggatacggaagggcttctcatcatcaccaatgacggggaaatggcccacaatctgctttccccgaaaaaacatgtggataaggtgtacatggcccggctttccggccagcttcccgcgaatgcgaaagagcggttttcggaagggattgtcctggatgacggggttaagacccttccagccctattagaatatgaggggcatggaaacggcccggaggggctgacggaagtcctcctcaccatccgggaaggcaagttccaccaggtaaagcgcatgtttgaggcgttgggctgccatgtggagtatctgaagcggatgtccatggggccgcttgggctggacccggaactggagcctggacaataccgtccccttacggaggaagaaatccgcagcctgaaggaagcgggaacaggtaagtgattaacggacagaggaattggagaaaatgaaaataaatcagaaaaaggcagttatatttgatttggatgggacactggtggattccatgtggatgtggaagaccattgacatagagtatcttgccagatatggcctggaatgtcccgatgatctgcagagggagattgaaggcatgagcttttcggagacagcctcttattttaaaagaaggtttggccttgaggattccctggatgggattaaggaagcctgggtccagatgtccattgagaaatataagaacgaggttaccttaaaacccggcgccagggcattcctggactatatatgggacaaagggatacctgccgggattgcaaccagcaatggccgggccatggtggacgcggtcctggattccctggacatacgcaggtatttccgggtggtggcaacggcctgcgaggtggctgccgggaaaccggccccggacatctacctgaacgtggcaggacgcctgcaggtggcgccgtcggactgcgtggtgtttgaggatgtcccggccggaatccaggcgggaaagaatgccgggatgaccgtgtttgcggtggaggatgcattttccctggacatgagggaagagaagatgcagctggcggattactatattaaggattactatgaattattagatggagcggcaggatgaaaaacgattatttacccatgaaccgtcatgatatgagtatcaggggatggaaacagtgcgattttgtttatgtatcaggggatgcctatgtggaccatccttcctttggcacggccatcatatccaggatactggaggcacatggatacaaggtgggaatcattgcccagccggactggaaggacaaaaaaagcattgaaatcctgggacgtccccgcctcggcttcctggtgtcggccggaaacatggattccatggtgaatcattattccgtatccaaaaaacgcaggaaggaagactcctatacgccgggaggagtcatgggcagacgtccggattatgcggttgtggtgtattgcaacctgatccgttccgtgtataaggatgcgcccatcatcatcgggggaatcgaggccagcctgcgcaggctggcgcattatgattactggtctggaaagctgaagcgttccgtgctcctggattctcaggccgacatcatctcctacggcatgggggagcgctccattgttgagatagcggatgccctggacagcgggattgacgtaaaggatatcacattcatcgacgggaccgtgtataaggccaaaagcctggagtccgtctatgattacaggctgctgcctgattatacggagcttttaagggacaagaaggagtatgcaagaagcttttatgtccagtacagcaacacggacccattttccgggaagcgcctggtggagccttatgagggaaaggtgttcgtggtccagaatccgcctgcaaagcctttgggccaggaggagatggatgcggtttatgaccttccctacatgaggaattaccatccctcctatgaagaactgggaggtgttccggctatccgcgagataaagttcagccttatcagcaaccggggatgcttcggcgcctgcagtttctgcgcccttaccttccatcagggcaggatcatacaggccaggagccatgaatccctgataggggaagcaaagcttctgactgaggagccggattttaaaggatacatccacgatgtgggcggccctacggcggatttccggttcccggcctgtgacaagcagctgacaaagggcgcatgcccgggccgccagtgcctgttccctgaaccatgtaagaaccttaaggcggaccacagcgattatattgcgcttttgaggaaactccgtgccctgccaaaggtaaagaaggtattcatccggtccggtatccgttttgactatgtgctggcagaccctagccgcagattcctgaaggaactttgtgagttccatgtgagcggacagctgaaggttgcgccggaacatgtggcggataaggtgctccagatgatgggcaaaccgaaaaacagcgtatacaggcagtttgtaaaggaatataaggagatgaacggcaggcttggcaaggagcagtatctggtcccctacctgatgtcctcccacccgggctcgtccatgaaggaggcagtggaactggctgaatacctccgtgacctgggctatatgccggaacaggtccaggacttttatcccacgccttccaccatctccacctgcatgtattataccgggtatgactgcaggaccatggaacaggtgtatgttccggtaaatccccatgaaaaggccatgcagagggcgctgatacagtacaggaaccccaagaaccatgaccttgtggcggaagcccttaagattgccggaaggacggatttaatcggatttgataaaaaatgcctgataaggccaagaagcagctacggccagggacagggcgcccagggaagcagaccgggccggacagcggcgggccagatgaaccagccgggccggaccgcaaaaggccaggggaagcagccgggccggacagcggcgggtcagatgaaccagccgggccggaccgcaaaaggccaggggaagcagccgggtcaggccgcagccggccgtccaaagaaaacaatccgcaacgttcataaaaagaaaggatcctgataatgaagattgccgtagtaaccggagcatcctccggaatgggaagggaaatgatcatccagctgtgggagcattttaaaggatttgatgaaatgtggatcatagccagaagggaaggacgtcttgacgaactggaccgccaggtgggggtcccgctgcgcaagtttgccctggaccttacaaaagaaaaggatctgcgtgtgttggagcgggagctttcagagaaggatccccaggtaaaattcctggtcaatgcagccgggtttggcaagatcgggaccgtggagtccctggccctggttgatgagacggacatggtacgcttaaactgtgaagcgctgtgcgccgtgacacgtctggtgctgccctatatgacatgcaacagccgcatcatccagtttgcatcctcagccgccttccttccgcagccgggatttgccatctatgcggcaaccaagtcatttgtactcagctacagcagggcgttaaaccaggaactgaaagccaggaacatttatgtgacatcagtctgccccggaccggtcagaacggaatttttcgacatagcggagaccacgggggagattcccctgtacaagcgtctggtcatggccaaccccagacgggtggtgtcaaaggccatcagggacagcgtggccggaaaggaaatttccgtgtacggtcttaccatgaaagccttccggatactctgtaaggtcctgccgcaccgcctgatactcaggatgatggagtggtgcaaccatataatctgaagataaggagaatccccatatgcagacattgactgtgacccccaatgaggccgggcagcgcatggataagcttctcgccaaatacctggaccaggccggcaaggggtttctttataaaatgatgaggaaaaagaatattacccttaacgggaagaaatgtgacggctccgaacacctggaggaaggcgatgaaatccagctgttcatggccgacgagaccattgagaagttccaggcagccccaaaggccccggcccggtcaacggccgggtacggatataaaaagctggatatcatctatgaagacaggcacatattggtggtgaacaaaccctcaggcatgctgtcccagaaggccagggagggggacatgtcccttaatgaatatatccttaattatctgattgattccggcggcctgcccataagccagctgcgcaccttcaaaccctccatctgcaatcgcctggaccgcaacaccagcggacttgtggtggccggcaaatccctggcagggcttcaggtcatgaacggggtgtttaaggacaggagcctgcacaagtattaccagtgcctggtggccggacagattaaggagaagaaactgatagccggtttcctgcgcaaggatgaggctgcgaatacagtgacaatctacccgctggaggtggaggacagcgtacccatcatgacagagtatcttcccctggcagggaatggaaaccacacgcttctccaggtgaccttaatcacaggccgcagccatcagatacgcgcccatctggcatccatcggccatcccatcgtgggggactataaatacggcagacaggacctgaacgacgccatgaagaagaaatacggcgtgcgttcccagctgctccattcctggcggctggtgatgcctgataaactgccgcagcccctggattacctaagtgggaaagagatggtcgcggggctgccggaccagtttgccagggtgcttaaaggggaagggatgatcctgtgattcttgacaggaagccatcttcaggttatgatagtacaagcgataaaatgtggaccggggcagcatgttccaaacaccctggcgtaacatgagaatgagaggatttttgaaatgggaaagattattttgacgggtgaccgtcccacgggacggcttcacgtaggacattatgtaggctcactgaagcgcagggtggaacttcagaactcaggtgggtttgatgagatttatattatgatagcagatgcccaggcgcttactgataatgcggacaacccggaaaaggtgcgccagaacatcatcgaggtggcgctggattatctggcatgcggcctggacccggcaaagtccgtgctgttcatccagtcccagatcccggagctgtgtgagatgagtttctattatatggatctggtgaccgtgtccaggctccagcgcaatccaacggtcaaatccgaaatccagatgagagggtttgaggcaagcatcccggttgggttctttacgtatcccatcagtcaggcagctgacatcactgcgtttaaggccaccacggtgccggtgggggaagaccaggctccgatgattgagcagaccagggagattgtgcacaagttcaattctgtttacggggaaaccctggttgaaccggatatcctcctgccggacaacaaggcctgcctgaggcttccgggcattgacggcaaggccaagatgagcaagtcccttggcaactgcatctacctgtctgacactgaggcagaagtcaaaaagaaaatcatgtccatgtttacagaccccaaccatctgcgggtggaggacccgggccaggtggaaggcaacccggtattcatttatctggacgcgttctgcagggatgaacattttgcagagtacctgccggattacaggaacctggatgagcttaaggcccactacatgaggggcggccttggggatgtgaaggtcaagaagttcctgaacaatgtgctgcaggatgaactccgccccatccgtgagcgccgtaaggagattgccaaggacatcccggccgtttaccgcatactggaagagggcagccgtaaggccaaggccaaggcggcacaaaccctggcagagatgaagcgggccatgaagattaattatttcgaggataaggaactgattgcagagcaggcagagcggttccgttctgagatggagtaggcgtatccgataattgctttccgtcaaatggaagaatgaaaatcattaaaatcataagaggattcctgaaaccatagggatccttttttctttatgatataatgtgtttaaagtatttttattggagaggaagcgtatgggacagtcaagggtaatgagatttacgttcacaaaggcggaaatcagggagtttgcagccaggatgacgttggctgctttgcaaaagctgtggattttctggattttattcattttgtacatggcaggggagcttatcatgacagtggctttgcagaggtcctggcagggttttgtcctaagccttataagcggggggagtgttttggcaatcctccttgttgtcatgtaccttatcaactattgccaggcgcttaaggcaggcatgctggagccggcggcctactggattgaggatggctgtctgtgctgtgaaaagaacaggaccaggataccctgcagtgattatgtgcgccgctgggagagccggcacctgatagtcctgggatgggaaagcggaagatataatttggcagcgaccccaataccgaagcgtgtgtttggggataagggggaaatggaagccttcctgtcagccttttgtccggctgcccatgccgccggccaggaacatgcaggcgggggaaggtttaattattatttcaggatggatcccgggtcctgggcacatgcctatatccagatgctgcaggctgtccgtgttttaagggcgccccgcatcaggaggatccggtgtatcctgttttttgtcttaaccgggttctatatacggactctcatgacaagcccgctgtatggcatcacgcgcttcataatccatgccctgccgtatcttatcataggcattgtcatatatgccatgggaaatccatggccaagtgaaaaggcgtacgccaggttctctggacatggacgtctggggaatgacgggaccggcatctgggaaatggctttcatggatgaaacaatcagggtccgtaaggggcagcagctgtttgactgcagctggcaggattacgcatatctgatggagtccgatgatacgttcctcctggtccgcctgtgcggcgtgctgcaggcccagttcctgccggttcccaaatgggtattcagcggcccggaggagatgcaggcctttgccaggttctgcgggagcaggggcgtgaccataaggaaggaacggattcagacatcactgaaaagggaaaaagggaaatggatcatatgcggggtcctgctgttggtgcttgtggttttttatgcccagctcaggattgcttattccattgccgccggttcggtccaacagaggatggaacgcctggtggaggatgggtcattggaaaaagggatggaaatggaaaaaacagggcagcggggaaccatggaggcctttgtttttgacccggcggattatccggactatgtccccattgaaatccaggtggaggtgcttaagtcccttgggattgacggactggaggaagggactgtggaggaatacaaaaagtggatggagcaggacccgtggagccgggccttcatggagggttatccatattattccctgttatcaggaatcggatcaggggagtatgacgaggagacgtatgagaagacaggctggtcaggaaccgtgtactggtttgattttgaaggctgggatatcagtgaggattacattgacatcatgaaaggggtacaggccattggaggggatgattttatcctgtcggatatggaggaggacacgtccggggtggactgggaaaatggaacaggcaccattgacgtgacctttaccctggacggcaggccgctaagattttgtgcggaaatggagaatgactggatagacagttcgttccttcaattcctgggccgctcccttatggagggcgggaaggaaaaacgcctctattacatgggagacaatggccagggggcaatccttttttataatacgcctgagtgggcggcaatgtttcaggagaagaccggtatcgaacttcttgaagccggtggatgactgcaggaatctgataaatggagaatctgataaaaagtccttgaccctgaccttaggtaagagattatactgaatccagatccggatcaggtaaaacagaaattgaatggaggagcaggagcatgctgaccataggacagatgtcaagggtttgcggtgtgagtgtgaagacgctgcatcactatgataaaatcggccttttgaaaccacagaaaacagatgaaaccaatggataccgttattatgaggattcccagatcggtaccatgctgcttatcggaaggctgaaacggtatggctttacactcactgatattcaatgcctgttgaccgtcaaagatagcagggagctgctgcgccagatgcatcagcagagattccgcctggagcggcagatggagcacatttccattaccatcagggagatgggctatcatctggaagaattcgaaaggacaggtgatatcatgagttatcagaataattatgagatagtggtaaaggaagcaggggagcaggtactggccacccacaggcagaagatgtcagtggaagagttcggcacctattatgggaagatatatgagaagattgccagggaacacctggaagtcaacggcattgtgatggcgatataccatgaccaggagtttgacccggccttcagcgatattgaactgggtgtgggaattacggagagggacaaggcggactttattttgccgggccacctctgtgcaaccacgattcacaaaggcgcgtattccggtcttcctgacgcatatggggccattgtggcctggattaacgctaatgggtataagatggacggaatgccctatgaaatctatctgaagacacattttgacaagcttcctccggaagagtgggtgacagagatattctttcctgtcaggaagtaatcagggcgtatcaggaaattgctttccgtcagctgtgcgtcccgcctggtggttccttagggcatatggcgggaagggactgtcaggcatgatctggcagggatggggccggtcttttttcgtcaggaagaccggtccttttttaatacctggatcctgaacggatggagtactggtaatattttcgattttctgaatatatccttaatatgcctgtccttccattgactggaaaccctgggcaccatatacttagttcatgaggaggttgtgcgatgaaaaaggtgtcgggtttatgaaggaacgccttaccacacatccgtatttgtgaataaggaaggagaaaacggctggacagcccttgactgggttaatgccgagacagggggagacagatgacaggtacagtaccgcgcggacaatcaggatgccggggcagactattcagcacccgggatatgtatgatattgagaggacagaggggctttttgtggcagcggtccgtgaaaactgtgcattccattacaggaactgtccggaatacaggaggatccttgattataccggattcagaccggaatccatagaaggaatgggggatattgcgggaattccctttcttcccaccctgttttttaaacgccacgcagtcttttccatgccggaggataaaatcaggacaaaagtcctgtcttccggcacatccggaatgtccagctgtatcggatatgatgcgggagccatggcctgcggggtatatatgggactgaaggtggctgccaggagccgccttgtgtctgccagaccggctaattatatcattcttggataccggccccatagggataacccaacaggagtgacaaggaccatgttcctgtctacctttttttcgcctgcccttagacgtacctatgccctggaatggaaggacgggcagtattatccggatatggatgggattgtccgggaaatgataaggtgcagcagatcctccttcccggtacggatactggggtttccgtcctatacatggtttgccttgaaactactggaacagaagggaatccgcctttccttccccaagggttcccggattgtgctgagcgggggatggaaacagcacggggcagaggaagtggataaaaaggtgctctaccgccttgcaggacaggtgcttggaatcggggaggaggatatcgttgagttcttcagcgcggtggagcatccggtcctttattgtacctgtaagaaccatcatttccatgtcccggtctacagccgtgtcatcatacgcgatgtggataccctgaaaccgctaggctatggaaagcagggacttgtgaacctggtgacgcccatgatgaaagcaacgcccatactcagcgtgatgacagatgatctgggagtgcttcatgaaggggcaggatgcggatgcggcatagcctccccttacctggaacttaaggggcgggcaggaatccgggaaatcaggacgtgcgcggcgggggcagaggcgtatctgcgcgggcaggagtggatgctttaggagagagggggaaggaactgggacatgattctggcaaatggaaaattatacgattccggcaggcagggagaggtccttgcctgtatggaggagcggattaacaggaccatggaagggaaacatctggaggcggacatggtgatatccgccctggcctgtctgggacagaagctggaacagaggtacgggtatccgcaggccgcaggaatgtttagccgtgaagccatggaggacaggcttatgcgggagctggggtatgcccgtccatatggttccgtgaagccatcgcccaatagccgtatctccacccgtgtcatgcctcttggaaccctgctccacatcggggcaggcaatgcggatttccttccggcttacagtgtggcagagggcctcctaacctgtaatgtgaacatactgaaactgccgggcgcggacagcggggcgtccttggaaatgctgcgcatgctcattgatatccagccggaactggctgattatatctatgtttttgatacctcttctaaggacagggatgcgctgatgcagctggcaggactggcagacggaatcgtggtgtggggaggcgatggggcggttacccaggtaaggagcctggcgcctcccggaatcaggctggttgaatggggacataaactgggctttgcgtatatttcaggatacacggacagggaagcggaactggctgccctggcagggcacatgatggccacaaagcagcttttgtgtagttcgtgccagaccgtattcattgatacggaatcttatgaggaaatcctggagttcggaaggggattcctggattacctggagcgggccgcagacagatttccaggcagcaatcctattgtggcaggcgcaatcagtctcagacgttacaatgatgaactggagcggattgtttatggggagggcacaggcgggaacaggatattccagggaaaaggatgcagcgtgaccgtatgcggcgatatggaactggaactgtcccctatgtttgggaactgcctgataaagcgtctgcccagaaacaaggcgtttggatgcctgcgccgccataaaggacatctgcagacagcaggacttatatgtgcaggtgaatgcagggaggaactggtgaagcttctgtgttcctgtggcgtgagccggattacagacgcgggaagcatgtcagccttatttgccgacgggacgcatgacggggagtatcccctgagacgttatgtcaggttcgtggatgtggaggaccctggtacagacctttgcaatgaacggtgaagacggcgtccgctgtctatgcagggctgtactggtcctcgatgggaggcggtattcctgcagggagtgggctttatggccaggactgcctatacacaggaaaggaggatgggatgtgaaaaagccttttcaaacaggaatcagggctgtcctggcagttatctgcatcggagcagtcctggcagcaatttacggttacggtatattacagggctggttcctgcttaataacccttccaggaaactatatccaatccgcggcgtggatgtatcccattaccagggcgagattgactgggctgtcttaagcggacaggatatacggttcgcatatatcaaggccacggagggaagcagccatacggatgggaggttcctggaaaactgggaccatgcaacggttacggatttgaaggtgggggcctatcatttcttcagtttcgacagtccggcagagacacaggcagaacattttattaagaccgtccaggggtttgacgggatgctgccgccggttgtggattttgaattttacggtgataaaaaagccagtcctcccccggtggaaccgacggtacaggagctgtgggtcatgctggggaaactgaggcagcattatgggatgacgcccatactctacgccacggaggaaacctaccatatgtatctggagggacgctttgatgaatatcccctttggatacgcaatgtgacggggcagccggatacggatacggactggctgttctggcagtacagcaaccgcgggcggctggacggatatacgggggatgagcggttcattgacctgaacgtgtttgcaggagacgaggtgcagtgggctgaatttacagaaacagggggacagacagatgaagcggaggggcaggacggactggaggattaggacaggccaggaaaatgacttgagaaaaaacagatgttctggtatactgatggaacacgggaaaatgactttgaccggaatgtttttttgaaaggaatgtatctgcatgggaacctggaacacaagaggcttaaggggatccaccctggaggatttaatcaaccataccaatgaaagctaccgggacaggcatctggcgctgatccagaaaatccccacgcccataacgcccattgagattgataaggcaagcaggcatataacgctggcgtattttgaccaaaagagtacggtggattacatagggaccgtgcagggaataccggtatgctttgatgcaaaggaatgcgcggctaagacatttccccttcagaacatccatccccatcagatccagttcatgaaggagtttgaggaacagggcgggattgcgttcatcatcctgtattttactagccttaacgagatgtattacatgccctttgagcatatatataccttctggaagcggatggaggacggcggacgcaaaagctttacctatgatgaagtggataaggcgtggaggatacgctcctttcgggacatgctggtgcattatctggaggggatacagaaagacctggacagaaggccgtgacggatggcaggaccttgctgccaggtcttttatggattatgggcggagcagtttttcatatgcaatcttgtcgctgttgtcaaaggtgaccacgccgcagtatccgtatccgttcttttccaggagatgcctcatgatggcattgtcctggtccgtatcgattttaatgctgtatatgccttttgaaaggcagagttcctcggcatggctgaacatgagggatgcaagcccccttcctttgcaggtattgtcgatggccagtctgtggatcacggcgtagggctgatggcttttccaggtcccccggagggattcgtaacatgtttcaccatcaaaggaaatgcaggcatacgcaatgatacggtccccgtctgtcatcacatatccgttgttgttcctgatatcatctgccacggaatcccggttgggatattccttctgccattggtccaccccctggtccctgaggaactgccgcgcctcttttatgatttcccagcaacggtcaatttccttatccgtggagcgtctgaatgcgggacgtgttcctgaatgtgtttctgattgtgtacctgccatgtgtttttcctcctttgctatcttgggattgaccttaaatgtaaataaaagtataatatagtggaatgtaggaaccaatatattggaagtctaccatattgtactattaatccactatattgtcaatcaggtatctggctttattggaggaaatgatggatattaatattaatctggaagtgggccgcaatatcaggcggctgagggaagcaaaaaaactgaccctggacggggccgcggcagcaaccggggtatccaggagcatgctggcccaaattgagaagggggatgtgaaccccactatttccgtactctggaagattgccaatggctataaggtatcctttacctcgctggttgagacaggcatggaggatgccgccgtcataagggcaggcgatatcacgcctatcatggaggacgggggaaactatatgaattatcccgtgtttgcctttgatgacaggaagctgtttgagacataccggattgtcataaagccgggaggatgcttaaaggcccggccgcacctggccggaaccgaggagtatataaccctgttttgtggtcaggccgtcatagaggcggccggacaggagtgggagctggcagagggggattccatccgctttaaggcggacacggcccacggttaccgcaatccggggacgggaaatgcagagatgagtatggtaatcttttatgggagacagtaggatttctgattgacaatccgtctgatatcccctataataatacaatcacgttatcgaattagcactttactacgaaaaagtgaaggtgaacgataacaaaggctgcaggtataatgatgcagatgcaatggcaaaagccaaagaatatgataaaagaggatgggacatgatggcaggaaagaaccgtttaatccacaccccggaaggcgtgagggacagttacaatgcggagtgcagaaagaaactggcggtgcaggataagatattgaacaccttatacctgtacggctatgagcatatacagacgcccagctttgaatatttcgacatattcagcaaggacaggggaagcgtgtcggaccgggagatgttcaagttttttgaccgggataataataccctggtgctccgcccggatatgaccccggccgttgcaaggtgtgtcgccaaatatttcatggatgatgacatgccgctgcgtctttgctacttggagcgcacctttaagaacaacagcagctaccagggaaggctcaaggagagggccgagatgggggccgagcttatcggggatgattctgccgacggggacgccgagatgattgccatggtcatcgacagcctgaaggcggcgggccttaaggaattccaggtggaactgggacaggtggcattttaccgcagccttttggaagaagcggggttcagtgaggaagtggaagaggagctgaaccagctggtggagaataagaatgactttggcgtggctgaactgcttaagggccaggatattgatgagggcttaaagcaggtgttcttgaaactgccggagctgtttggttccctggaacagattgtccaggcaaggaagctgacatcctcccccaaggccctggctgccattgaacggctggagcaggtccatgccatccttcaaagctatggactggcggattatgtgtcctatgatctggggatgctcagcaagtatcattattatacgggaatcattttcaaggcatatacatatgggacaggggattatattgtcaccggaggccgttatgataagcttctggtccagtttggcaaggatacgcctgccgtcggcttcgccattgtggtggaccaggtcatggcggccctgtccagacagcagatagatacgcctgtgaccctggtgaacacggttatcctctatgaagccccggccagggataacgccatacgcctgggccgttattttaaggaaaagggccttgccgtccagtccatgaagcggcggcaggataagagcctggaagattacagggacatgacgctggggcgccacatgaggaacctcctgtatctgaaggatgacggccgggtggtcactgccatggatatggtgaacggcagtgcggatgagattcccattgaggcgtatgagtaagaattgaattatcggagggcttgaaggcagatgagatatttaacaatagcactggcaaagggcaggctggccaaaaaggccatggaactgtttgaggcaatcggtatttcctgtgacgagatgaaggataaggattccaggaagctgatatttgtaaatgaggagctggggatccgtttcttcctggccaaagccaatgatgtgcccacttacgtggaatatggggcggcggatataggtatcgtgggcaaggacaccatcctggaggaggggcgcaagctctacgaggtcatggacctggggatgggcaggtgcaggatgtgcgtgtgcggtcctgaatcggcaaaggagagcttaaggcatcatgagctgatacgcgtggccaccaagtatcctaatattgcaaaggattatttttataaccagaagtatcagaccgtggagatcatcaagctgaacggttccattgaactggcgcccatcgtggggctgtcagaggtaatcgtggatatcgtggagaccggctccaccctcagggagaacggcctggccgttctggaggaggtatgcagcctgtccgcccgcatggtggtgaaccaggtgagcatgaagacggagaacgggcgtatcacgaagataatcaaggatttccaggcactgcttaaggaggataattaaatgagaatcataacattagacgatgcatccatgaagaatatcctggctgacatgctcagacgcgacccgaacaactatgacagctatacaaagaccgtggaagcgattgtggaaaatgtaaagaaccgcagggatgaggccgtgtttgagtatacaagggaatttgaccatgcggacctggatgcatccaacatccgggtgacacaggaagagatagaagaggccatggcccaggtggacgaaggccttcttgcagtcatgaaaaagtccatggacaatatccgccgttaccacgaaaagcagaagaggaacagctggtttgacgcccagccagatggcaccatactgggccagaaggtgacggcccttgagagcgtgggcgtttatgtgccggggggcaaggcggcctatccatcctctgtgctgatgaatatcataccggccgaggttgcaggggtaaagcggattgtcatggtgaccccgccggggaaggacgggaaggtgaatcctgtcaccctcacagccgcccatctggcaggcgccaccgaggtgtataaggtgggcggggcccaggcagtggcagcccttgcctttggcacccagtccatacccagggtcaataagattgtgggaccgggcaatatctttgttgcccttgccaagaaggctgtgtacggccatgtgagcattgacagcattgcaggccccagcgagattctggtgattgcggatgacagcgccaatccgcgctttgtggctgccgaccttttaagccaggccgagcatgatgagctggcaagcgccatattggtgaccaccagcatggagcttgctaagaaggtgtcggatgaggtggatggtttcctgaaggtattatccagaggcgatatcattgcaaagtccctggataattacgggtatatcctggttgcggataccatggaaaaggcggtggagacagccaacaatattgcgcccgagcatcttgagattgtaacggccaatccctttgaggtcatgacgaaaatccagaacgcgggggccatcttcatcggcgaatacagcagcgaacccctgggggattacttcgctggaccgaaccatatcctgcccaccaacgggacagccaaattcttctcgcctcttggagtggatgacttcatcaagaaatccagcatcatttactactccagggaggcgcttgagaaggcccataaggatattgaattgtttgcggagtccgaacacctgaccgcacatgccaattccatccgggtacggttcgaaccataggcttaatgcctgttttttggaattgggtgtgaacgcgcttcatgataccggggcagggttcctggtcgggggtcctgggtggcattcctggtatgggttcccgggtgggattcccggacggcgccaggtatcgtcaagccacatgaaattaggagggatatatgatggaaaggacggccgtggtaacacggaatacaaaagaaacagaaatccagataagccttaacctggatgggagcgggaacgcggatatccagacaggcatcggattctttgaccatatgctgaacagttttgcccgtcacgggttctttgacctgaccgtaaaggtgaagggggacctggaagtggatacccaccacaccattgaggataccgggattgtcctgggacaggcgattaaacaggctgtgggggataaaaaagggattgtgcgctatggttcccagatcctccccatggatgaatccctggtcctgtgcgccctggatctgtgcggcaggccgtatctggtctataatcttgacctggaccgtgaaaaagtaggggatttggagacagagatggtccgggaattcttctatgccatttcctatgcagcagaaatgaacctgcacatcaggcagatggcaggcatgaacaaccaccatatcattgaagctgcctttaaggcatttgcaaaggccctggacagtgcggttgcagcagagccaagacttacaggcgtgctctccaccaaaggaagcctttaggaaggaggccggcagtgggagaagggacaccggcaggggaagggatggcaggaggccatgtcctgtccaaaaagatgattggcctggcatacgggaatagaaagcttatggcgggaatcctgctgctgatattaggattgtcttctgccctggccggactgatgctggaccaggaggccagaaggggatacagggaggaacagaacctcgcggttccctttgattccagtgaaccaggtggatacagctatgtcaggctgcagtatctgacggatagttttgcggaacacgtaaaatcagaagagaattattattacgggtttgattttatgttcaggccctacatcatttccatgaaaggccatatgcctgagaacctgatggccctcatggactatacatatggggatgggctttctgagccacctcctgcagtggatgtatgcggctatggaagacccattgtgccggaaatgcttggatacgcaagggagtactacagccagctgtgggaggaaacccagcttcccattaccatggaggatctgacccagatagtggggaactactatctggacacggttcccaggacctacctggagcaatatccctggtccgtcctgttttatgtgattccggcgctgattctggttcttggcgggaaccggctgttccggtacttcaggggactgaaggcccaacgtgcgggcctgtttggaaggccggaggagcttagggcggcggacctggaactgcagcacacggatgaggccgtcaaaggcagccgcgtttacctgacagagcatttcatcgtgacatccttttaccggtttgatgtgattccatacaccttcgttgaccggatggaggccagcgggggatttgtgattgccgtcaccagggatgggtatgcacatatcgtgtcaggcggcaggcatgggggacagatccttgggatgcttcaaaggaaactgggacagacaggacaataaacagaaagaggagaaaccaatgcagttatatccggcaatagacatgaaggacggacagtgtgtccgtttaagacagggagaatttaaggacattaccgtgtattcggatgcgccctggaaggtggcggcctggtggcaggcgcagggagccaccttcctgcacctggtggacctggatggcgccctggcaggccattccgttaacgaggaggccatcaggaagattgtggaccatgtgtccatacccatagagataggcggcggaatccgctcagaggaggcagtgcgcggcatgcttgacctgggggtgaagcgggtaatcatcgggaccaaggcagtggagcatcctgaattccttgaagagatggtcggtaaattcggggaagacgccattgtggccggtgtggatgccaggaacggaatggtggcggtggagggctgggaaaaggtcagctccatgactgccagtgaattatgccttaagatgaaaggctatggcgtaaagcatattgtgtacactgacatatccagggatgggatgctgtccggccccaatgtaaaggccacaaaacgtctgaccgatgacacgggacttgacatcatagcatccggcggggtatcctgtatgcaggacctgaaggaactgcatgaggcgggaatcaggggagcaatcattggaaaggccctttatgaaaacaggattgatctgaaggaagccgtaatgctttatgaaaactaggagatacatactatgacggattacaaaaagctgatattaggatttggcgtaaaggaaggcagggcatatacctgggacggacggaccgtgtacggcagccctctggcagtacttgcaaggcaggggtgcgacaacggggcggacgaggtgctgatatatgaccattctgaaagcgatgaggaccacgagtccgtaatcggcatcatgaaggaaacagccaggacaatcgatgagcccatactggcaggcggccgcgtaagacgcctggaggatgtgaaaaagtatctttatgcaggtgcaagcgcggtctttctggatgtgggccgggaagataatgtggacatgatgaaggaggccgcggaccgttttggaagggaaaagatatatgcctatctccccaacgtatcctatatccccaggatggaggagtatgcgcagcttggcgcatccgtgatgattgtcaggacctctgcccaggtcccatccttacaggaactgggggaaatcggcgagggcggacatgggacactgatattctgcggcggccacgactccatccaggacatggccggcgagttgaaaatccatttcggctgtccccaggtccagggcgctgtccttacccttcaggaaggaaaaacaggctcctgcatggagatgaaacagatattaaaaagcgcaggcatatcaacggatacctttgagagcgccgtgtcatggaatgatttcaagctgaacagcgacgggcttatccctgtcatcgtacaggattacaaaagcctggaggttctgatgctggcctatatggacgaggaggcattccaggcaaccctgaccaccgggaagatgacctattacagcaggagccgcaggaaactatggcttaagggcgaaaccagcggacattaccagtatgtgaagtccctgaagatagactgcgacaatgacaccatccttgccacggtaaaacaggtaggggcagcctgccacaccggaaacaggagctgtttctacaccaccctggcggaaaaggaatacaaggaaaccaatccgctgaaggtatttgaggatgtctaccatgtcatcctggaccggaaggaacatccaaaggaaggttcctacaccaactacctgtttgacaagggaatcgacaaaatccttaaaaagctgggtgaggaagccacggaaatcatcatagcggccaaaaacccggacccggaggaaatcaaatatgagatatcggatttcctgtatcatatgatggtgttaatggctgataaaggtgttacatgggaagaaataacagaggagcttgcgaaccggtagggggatgttgggagaggcagagggagtgtgacgtaggttatgtagcctctgctttttgcgttctccggaggaatgggcgggggacaggcagggggacggttcctggttccgggggcatggcctgctaactcaaaaaggcggcggaaacagggcaccgcgccaactaccgaagaaatcttcatgatttttcgtccgtgggcgctctgcactcgggcttggaagccctccctcggccctgtttccgccgcctttttgagcaagcagaccaagcccctccacaaggaaccgtccccctgcctgtcccccgcccattcctcctgccaaggttccagaagaggccgctgagccttccgccttccgccatctgccatctaaaccaaaaaaagacaaatttaaaagacaacccgatacttttcaattcccggcccgatttaagtggtatagaagggaatataaaacgtagcgggtgagcggaatggggatgggggagatggatgcatctacaggaccgtgctggacttagggtgtgggaaggggcgctaagaggctggcgccattgtctgagcccgataccaaaatacctggtagaagaccaggcgcgagttttggcagccagcctcttgtccagcgccggttgccacacccttagaccagctaggtccgcagcccgcgtccatctcccccatccccattccgctcacgaacggatgcacctcccccttctccccctaaaatccccctaaaatcccccaaaacccatcattgagtttttgataccactatgttaaaataaaatggattaattatctatatttcataccatttatatcctaaagaagaggagtaaagttatgttttcacgaaagaagattttggtggtggaagacaatgcacttaaccggagcctgttgtgccagattctgtccgctgactatgatgttgaggaagcagagaatggccaggaggcccttggggtgttgaggcagtttggagaggggatatcccttatcctgttggatatcatcatgcctgtcatggatggttataccttcctgtccattatgaaagcagacccttcttattcctctatccctgtcattgtcacgacccagaacgatgccgagtcagatgaggtggcggccctgtcccacggggcaacggattttgttgcaaagccttataagcctcaggtcatcctgcaccgggtggcgggaatcatcaggctgcgcgaaaccgctgccatgattaacatgatccagtatgacaggcttacgggactttacagcaagcagtatttttaccagcaggcaggcgaggtgctcctgcgcaaccctgaccagcagtatgacataatatgttcggatattgagaacttcaaactgattaatgatgtattcggtgtcaaggcaggagacagcctgctgcgcggaatcggcaatgcttacgcggagcggttaaagggtatcggtatctgcgggcgtcttaattccgaccagttcgcatgcctggtagagcataggggtgactatgcagatgacatgttcattgaggccagcgccctggtgaacggattgcttgatatacataatattgtgatgaaatggggcatctataatgtggaggacagatctgtgtccattgaacagatctgtgaccgcgcattgctggcagcccggagcatcaaaggccagtacggcaagtattttgctatatatgatgatacgctgcgcaaccagcttctgagggaacaggccattacggacagcatggaatccgcgctgtcacagaaccagttcctggtctatctccagcccaaatacagaatcaaggacgaggccctggtgggggctgaggccctggtgcgctggaaccatccggtctggggctttttatccccggctgaattcataccattatttgagaagaacggattcatcaccaggctggaccggtttgtatgggagaaagcatgcgccgtgctccatgactgggatgagaggggatattatcccatatccgtgtccgtgaatgtctcacgggcagatatctataatgaggatcttgcagacaccctggttaagatcattgagaaatatgacctggctccgtcacgtcttcacctggaaatcacggaaagcgcctacacggagaatcccaaacagatcatcgatacggtgacaatccttcgggaactggggttcgtgattgagatggatgatttcggaagcgggtattcatcccttaacatgctcaatgacatgcccattgatatattgaaactggatatgaagttcatacggagcgagatggcaaagcccaaaagccagggaatcctccagttcatcatcaacctggcacgctggatgaacctgagcgttgtggccgagggagtggagacaaaggcgcagctcttaaggcttacggagattggctgtgattatgtacaggggtattattttgcaaagccgatgccatgtcaggaattcgaagggctgttggatgattacaggggagcggggatagaagaacccttaacggacgcggaggccaggaatgagcttccaatcctgctggttgcggacgaggatgaggattaccgggacatggtgcataaggcatttgagggccggtaccgtgtggccggtaccgcggattgcaccgataccctggcattcattgaagacaatcaggatatcgccgcggtggtattgagcctgaccctgcccggaccagacggtttcaaggtccttaaggccatacagaaggacaggagtctgtggaaccttcccgtcataaccacgtccgggccggatccggaacaggagtacagggcgctggaacagggggctgatgattttattgcaaagccacatttaatgcagagcctttcaagacggatacagagaagtgccctgttttacgcatcggctggagtggcattgacccggcagggagaaacgcccctggaagccatgaaacgcatgaatcctgaggtcccgggggttcagaatacaaacaaggataaatactgcctgtggagaaaggaaataatatgatggaccacatagatgcaaatcagacagtgcggctgttctgccaggcatggtttgaacagagggatgccggggcagcccttgaatatgtggcggatgatatacggttcgtgggcacgggggacaatgaatatgcctgcggaaaagatgatatgttccaatatctcttacaggatatcagggagataccggaaccattcggagtggatttttccgttgtctacgagcagtatccggaggaatcagtttacatcctgtcctcggaattcacattgaggaatacggtttattcctggcttttgcggtgctttttcgtactccacctccaggatggaagatggctggtaagtacccttaatttctctgagccagcctccagccagaggaacggggagcattatcccaaggcgctggtcatggagaatatagctaagcagcgtcaggaactgttgaatgaggcctttgcaggcggtatgatgggccactatatgggggatggctcccctttttatttcatcaaccagagaatgttacgatatctgggatacctggatgaaaaggagtttgtggaagagattgacggatgtatcagtaactgcatccacccggaggaccgggctttggcgggacaatccattgcagcccagctggacaggggggaagagtataccgtagagtacaggatgaggaaaaaggacggatcctatatctggatccatgataccgggcataagacggtagcagaggatggccgccctgccatcacatccgtgtgcagtgatatcacggcccagaagctggcccagttagaggtaatgaacatctacaataatatcccgggagcagttttccgctgccggtttgattctgatttttccgtgattgatgccaatgacggcctttttgatttccttggctattcacgggaggaattcgcggcaatgggcaaccggatgtcagcagtcatctatccggaagacctggcagtcatggaggaaaaactgagggcccagcttaagcatggcaataccatccagaatgaaaaccgtctggtctgcaaaaatgggcaggtaaaatggatttccattaaagcgcagctgttcaccggtgaaaatggggaacagtatttttactgtgtattcgtagatgcaacggacgagaaaaatgtccaggagcgggtcaaggaactgtatgagaaagaactgctttattttgccgaactgtcctctgagggaggcctggtacagggaaggcttaatgttacacagaacaggctggagagccatgcctccacagacgatgcatccgttgcggaaataggcgatacatatgaggaggcagttgcgaagctggcaggttccgcggtggatgcggcatacggcaggaaaatcctccatgacttacagcgggaacgggtgctggccggctatgcctcaggcaagacaacctatcactttgatttccagcgcaggagcatccgccggggatccttctggtgcagcgccagcctgcgcttctgtctgaatcctgaaagcggcgacatcatatgctttttctatacctttgatgtgaccgagaagatggttcaggagcagctgctctataggatagctgaactggattatgacatagtgacggagattgacatacaggaagacacacaccgtccggtttccatccgctgcaatcagaaggaacaggtgccaaagcccggcaggttccaggaatccatacgggggattgcggcccagtgtatggaaaaggcggccagtgaggagtatcttcagaaactggattaccaatatattaaggatcatctggaaaaagaggacagctattcctttattgtggagatgagggaccgtgcaggcgtgatgcgtgtaaaacggtttcaggtcttctacatcaataaggccctgggtcgtgtgggcatgtcccgcactgatgtgaccgatgttgttcgcaaggagcagagacagaaggaagacctggcagcggcgctggttgcggcagagcaggccaatgcagccaagtctgacttcctttccaggatgagccatgaaatccgcacccctatgaacgccatcattggaatgagcaccattgccgcccagtccatcggggatgatgaacaggtggaagactgtatctccaaaattggaatctcctcccgtttccttctgtccctgattaatgacatcctggacatgagccggattgagagcgggaagatgctgcttaaaaatgaaaaaataccaacagaagatttcctgaacgggattaattccatctgctacgcccaggccgctgccaggggcgtggattatgagtgtatcgtggaccctgtgctggatgactattacatgggcgatgccatgaagctgcagcaggtcctgatcaatatcctgagcaatgcaattaagtttaccaaggagggcggtaaggtgacgctctcggcagccctgcgcaggaagaccaagaatgacgccgtcctgaggttcattgtcaatgatacgggtattgggatgggagaggaattcatcccccatatcttcgaaccgttttcccaggaatccacaggcaccaccactccttatggaggctctggcctgggcctggccatatccaaaagtattgtggatatgatggatggcaagataaacgtccgctccattaagggaatcggcacggaattcaccgttgatgtgaagctgggaattacggaggaagaaaaactccgtcacaataaaaggaaagccgtccataatttttcccatctgaagaccctggtggtggacgatgatgtggctgtctgcgaaagcgccattgtcacgctggaggaaatggggattaaggctgaatgggtggacagcggccgcaaggcagtggaacgggtaagcatgctgtgggccggcggcaggtattttgacatgatattgattgactggaagatgcctgaaatggatggcattgagacggcgcgccgcatccggcagattgtgggaccggatgtgaccatcatcatcatgaccgcctatgactggatatgcattgaacatgaggcaaagctggcaggggtaaacctgctgatgagcaaacccatgtttaaatcatccctgatttctgcgttcacaagggccttgggggaaaaggaagaacaggaacgccagccggaagcatcagactatgatttttcagggaagcgggtgctgcttgccgaggacaatatcatcaataccgaggtggcggtcatgcttctggaaggaaagggctttggggttgatacggcggagaacgggctcagggccatggagatgtacggcaagtcgccggatgggtattatgacgccatcttaatggatatacgcatgccccttatggacggcctgacagcagccaggaacatacgccatctgagtaatccggatgccggaaccataccgatcattgccatgacggccaatgcctttgatgatgacattgaaaagagcaaggcagccggcatggatgcccatctggccaaacccattgagccggaacggctgtttcaaaccttatatgactttatttttggaaaggaggcctgacaatgggggagttcaggaaaatatttgaggcctacggggcggattacaactccacaatggcgcggttcatgggaaatgaggccatgtatgtaaaatttctggacatgctgtttaaggatgacaaccttgagaagctgggaacagcccttgggcagcaggactatgaggctgcatttgctgccgcccatacgcttaagggggtagtggggaatatggggctgacccctctttttaacgcggtctgcgccattgtggagcctcttcgcaacggtaaggacccggatggttataccgcattatatcagatcatccggtctgaattcctacgggcggatgaacttcgggcaacactgaaagaagggcggtaatcatcatgacaggcacttctttttatgaaggacagatgaggatggcttttgacagcattccctgcggcctttgtatttaccagattgaggacgggcagatcctgcccaggttctgcaacccggcttttcatgaaatcctgggctgttccgatgcgctcaggtctgatgcaggccaggtcctggacctgaaacgggtccatcccgaggatgccgggccgctgaagggaaaactgtccgccctgattcaagacaaaggcaggctttgccataccttccgtctgtttaatgacaaggaggataaataccgctggatccgcctggaaggatccgtaaggaagctggaaggcggggaaatgatgctttatggcgtattcagtgacgtgagcagccaggtgcggacggaacaggaactggctgatgccaatgccaagatggaggacatcatcaatgccattcccggcggtgtggccatctacagggtatcggatatctttgaaaccgtttatttttcagacggtgttccggaactgtccggctatacggtggaggagtacagggagctggtcaaaggggatgcggcggagatgacctacaaagaggatactgccatggtggtatccagggcaatggaggtcatccgtctgaggggcgtggatggttttgagttccgcaagcagcaccgggacggacatgttgtatgggtgcatgtgcagatgaaatggattggtgaggacaggggctgccccctgctgcactgtgtgttccacaatatttccgacctgaaagagacacagctggaaatgaaccatctgattaactccattcccggcggaattgccattttccaaaaagaagaaggtgcctataaagccgaattcctttcagacggtgtgattgcccttgccggatatacgagaagtgggtatgaagccctgattcagagggatgtccttgatattgtccatgaggctgaccagaagcgggtccgcggcgctgttgacaatgcagtgaagagcggcatggtgctggatgtattttaccggatccgccataaggacggtcacctggtctggatacatatgaacggaagacgcatgggacccctgaccggacacgcaaggctttatattgtagttacaggtatgtcggcagagacacgcctgttccagacaattgccaatgagatgtcagattccatctatgtgattgacaaggagaattatgaccttctctatgtgaatgagaatgaggtcctttttgcggattcaaagaactgtgtgggccagaaatgctatgcggccctccatggacaggacagcccctgcgggttctgcgccttaaaaacccatgcggcggacggacaggaacatcagatgcgggtagatggctcagaccgtttttatgtgacccgtttcaaggagagcgactggaatggaatcccggcgtatataaagtatgtgcgggatgtgacggaggaggtaaggacacgcagggagaaggaacggctggaggagtatttccagaccgtgataaagaacctgccgggcggtattgccgtggtaaggtttgagaaggacggcagcatggtgccggaatatatgtcggacggatttgcggccctgacagccatgccccttaaccaggcctgggaactttacagccaggatgccatgtcgggtgtccaccccgatgataaggagcgggtggctgaagagataacagcgttcataaaccagggcggaagcagccttgaaatggtgtaccgcctggtgcgcggtgacggcagttatgtctgggtgaagaataccctttccacacttctcagtgaaggcggtgagagccggttctatgcggtttatcatgatgtgacaaaggagcgggaggaacaggagcagctgcgccggcagtttaaggaacggttgatgcagcattatggcacaacggaccccaatgtactgatcatggggcattgcaatatcacccggaaccggatcattgaaatcagcgaccatacgggttcccatttgctggagacctttggatatgacagggaggcgttctttacagggattgcaggcctggtggaagatggggcggagcgccggacatttttggatacctatctgaacgcgccgtccctgaaagctttccgggagcaggatacggagaagatactccggtgttttattaagctgcccaatgagaagaatggccgttatgcacagtttaaggtaaatctggtggatgcgccggatacgggtgatgtgaccgggatcctgaccgtgacggatatcacggagcaggtcatcagcgaccgtatcatgcatcagctttccgtgaccagctatgattttgtcatagacctgaacctggagcaggacacctacacggtcctgacctgtaatgagaatgccagctgccttcccagccggtcaggatgccactcagaacatctggaacatatgcttaagacgataatcgtgccaaaagacagggaacagtttgcaggctccctggacccggcggaaatcaggcggcgtctggagaaggaggaggcatatacattttcattttccatcatggatgagaaccgggatatccgtaccaagaacatgacggtttcggcaatagaccttcgtctgggccgggtctgtctggtgcgcacggatataacggattccgtgcgggagcagcagggattccttaacatcatggcatatacctttgacctggtagggattatcaatatatacaccggccgcctgaccatgcatacgcgccagaccgtgctggagaacctgccgccttatattgcggacgattatgaacaggcggcagagcggtttgtgggccattatgccccaggagaggaggatgggtccgtccgccagttttgcctggaacatatcctccggaccctgaaagcaaaaccaggggggtatgattttgtttttccataccatggggatgaagggatacgctataagcagattaatgtgctgtggggggatgagaaccaccgtaccgtgtgccttgtaagggcggatgtgacggatatgctggcagaggagcgcaggaggaagaaagcccttgaggaggcgctggctgttgccagggaggcaagccaggcaaagagtgacttcctttccaccatgagccacgatatccggacccctatgaacgccatcatgggaatgacagtgctggccaaggcccatctggatgagcgggagagggtggcggactgcctgcagaagatttcggtttcctccagccatctgctgagcctgattaacgatatccttgacatgaacaagattgagcagtccaaaatcagcctgaaccatatgaagatatccatgtccggccttctggaaaaactgtccgatatcatggagccccaggccaaggcgtcgggacttaggtttaccatccaaagcagggggattgagcatggctattattatggcgacagcctgcgcattaaccagatactcataaaccttctgagcaatgcggtcaagttcacgccggaaggcggcagcgtggagttcctggcagaggagataacgccaatcaggccccagggctatgcccgctaccggtttacggtcagggatacgggaatcggtatgggggaggagttcttatcccatatttttgaaccctttacccgcaatacggcgagggtggaaggaaccgggctgggtctcagcatcaccaaaggcctggtggatctcatgggcggatatatcggcgtagaaagcaggatccataagggtaccacattcagggtggagctggaatgtgagtacgcggattgcggtggaagggatacagagaccgctggcgcggaggatgcagggggtacggggaccgggccggaccaggtgtttgcaggccgcaggttcctgattgcggaagacaatgacatcaatgcggagatactatgcgaactgcttaagatgcggggggcagtgtctgatgtgatggagaacggcgccctggcattacaggcctacagggacgctgctcccggtacatatgacgctgtgctgatggatatccgcatgccggagatgaacggatatgaggcggccagggccatccgcggtttggagcgcggggatgcagggcagataccgatcatcgccatgacagccaatgcattttccgaggatgtacaggaggcactggatgcggggatggatgcgcatattgccaagcccattgatatggaagtattaaaaacagcccttatccgggtcctgaaggggattgtataaatatccgaacattatattagattttgcccttttaaatattgacttttaattaacaaaatgagataataagaaggatttcgataaaatgaaagagaggataatgaaagatggcaaatgttgatttgagtcagtatggtattaccggaactacagaaattgtttacaatccttcttttgagatgctgtttgaagaagagacaaaacctgaactggagggctatgagaagggccaggtaagcgaacttggcgctgttaatgtcatgaccggtatttacactggacgttcacctaaggacaaattcattgtcatggatgagaactccaaggacactgtatggtggacatctgatgaatataagaatgataatcatccggccagccaggaagcatgggatacggtaaagaagattgccctggaagagctttccaacaaaaggcttttcgttgtagacgcgttctgcggagcaaacaaggacacacgtatggcaatccgtttcatcgttgaggttgcatggcaggctcatttcgttaagaatatgtttatccagccaaccgctgaggaactggaggactttaagccagatttcgttgtatataatgcatccaaggcaaaggtagagaactacaaggagctgggcctgaattcagagacagctgccatgttcaatatcaccagccgtgagcaggtcattgtcaatacatggtacggcggcgagatgaagaagggcatgttctccatgatgaactacttcctgccattaaagggcattgcttccatgcactgttcagccaacaccgacctgaatggcgagaataccgctattttcttcggactttccggaacaggtaagaccaccctttcaacagacccgaagcgtcttcttatcggcgatgacgagcatggctgggatgacaacggcgtattcaactttgaaggcggatgctatgcaaaggtcatcaacctggacaaggattccgagcctgacatctacaatgcaatcaagcgcaatgcacttttagagaacgttaccctggatgctgacggcaagattgattttgacgataagagcgtgacagagaatacacgtgtatcttatccgattgaccatattgagaagattgtacgcccggtttccgctgctcctgctgcaaaggatgttatcttcctgtcagctgatgcgttcggcgttcttcctccagtatccgtcctgacaccggagcagacacagtattacttcctgtccggctttacagcaaagcttgctggtacagagcgtggaatcacagagcctacaccaacattctcagcttgtttcggacaggcattcctggaactgcatccaaccaagtatgcagaggaacttgttaagagaatggagaagagcggtgcaaaggcatatcttgtcaacactggctggaacggcaccggcaaacgtatctccatccgcgatacccgcggcatcatcgatgcaatcctggatggctccattgccaatgcacctacaaagcagcttccatacttcaactttgagattccgaccgagctgccaggcgtagaccctgcaatccttgatccacgtgatacgtacagcgatgtttcacagtgggagacaaaggctcaggatctggcacagcgctttatcaagaactttgcaaaatatgagggcaatgcagcaggaaaagcattagtttccgcaggcccacagttataattgttactgaatcaggtcatttgtggactggattcatcatataaggattgatatccctgtatagaaacaggcagcctgtctccggattgattagagacatggctgcctgtttctatacagggcagatatatgctatttcttatagaaacagttgccgtccacaacggtataggaggcataactttcataatccgcattcttggtggaattaaagaagagatagtcgccgatgttattggttccgctaagggctgctttggtggctttcagggcgctggaggagggacccttggtcaggtacttgtccaacaggccggaggtggctccgggaaactgtccctgtgcatatatgacatcggttacggaactgccccagcgaccggatttgacgcggttcacaatggtgctggccactgccagctggccgtcgtaggaatagcccccggcttccatcatgacacaggaggccagcagataaatttcatcagaggaaacattgatgacatatttgggcgcttcttctgcttttttcttggtctgctgtttttctgtttctttcagggcggccagttccgcttcaatgctgattgccttgccaggtgacacgctgattttagtgtagtcagtggatacatagccgctggtatctgaggccagctggattttggcccagccatccttttcttccagcacaggatagtagtcgtccccggcagccaggccgattatggcggattcggtggttggctcctcacgcacattcagtgtctgtgtggttaccctggctgtaaacagtcccagctctttggcaagcggtctgatgtcctgtccaaatacaaggtagtcattgttcagccagccctccagtttaccggagcggattttggtccagccgtcttttttctcaaggatggtgcctccagcccctctgtagcacttgccgatgatcttgccttctaaggatggctccgcccgcaggttcaggacatcggtaacattggccacaaccttgttgtcatattcggatgcagcaggagcatgggtgacaggcacctgattggggctgatggaggctttgggcgccgccgtgtcagccggtattggggaaatggaaacttcctgcgaagcctctgccgtcagtgcctcaggaatacctgccgggttaagcggtccggccgggtatattcccagtgcggttataacggctgccagggcaagggatgtccatttccagtcagtgtgtttatgcatctgtttcttaaaaccccctgtatccatagagttatttttgttcccggtgtaaatgttacagaaatattacaaagatactatagcaaggttttgcggtgttgtcaagttttcacacgcttgcgtttccatggtgcatccgatataatagacatattatttcgtgtcgcaggcagcaatccgatgtggaaccaatggcaacagcagggaaatacaaggagaaaagtcccggaaggagtatccatatggcagagctttgtgttgatcagataaggagtttcagactgcgtaaccatcatctggatgcagtatacaaaagcacggacatggaaatgcttgccggtgcatgtgggatgcttaacaccccgccaggcgcatgggaaacagctatgtataaccgtgcgccggagtgcgggctggcggacatggagcagcatctatatggggataagacattgctgcaggcgtggagccttcggggggtaccggccctgttcccggtcccgctaagcccggtattcctgtctgccctggtgccagtcggggatgaaccatggatttatacccatgggatggccggagccatggacttcctaaagatggattccaatacattgctggagacgctgaaacaggtcatgacacgactggatgacacaactatcgtgagcaaggttacgctggataagacactggctgagtggatgctgcctttgctgcctgcggacaaaagggatttgtggaaccagccctccatgtatggcagccctgacaaacagaccgtgggcggggcagttgtctccttcctgttaaggccgtgcgccttcagcggcctggtggtattcgggaagcgtagtggaatcagccccacatttacctcctataaaaactggacagggcagatgttaaaagcagatgaaaacgcatccaaacagctggtccacagttacctgcactgttatggcccgtccaatgtggatggatttgtgaactggctgggatgttccggcaaacagggaagacgtttatggaacatggtttcagaggaaatggagccggtcacgttggctgggaaaaagtcctttatcctgtctgatgacagggaaatgcttttttcgccgccatcctttgacagggaaataatccttttgggtggccatgatccatacctggaccagcgggaccgggcagtcctgcagccggacccgaccctgcagaaacagatatggaggctggtggccaacccgggcgcagtggtgtaccggggtgaggtggctggcatctggacaagtaagaaaaagggaaagggaatggaaatccagatgaagctgtggaaggaaatccatcgcaggcagggactcctggagcttgcggaggaatacgccgggttcagacagcagaagctggcgggcattgacctccaatgaaaccgtttctttaatttaagtcaatgccagggttaaaataaccgaaggacataatttgctaattgtattggcagcacggatccgccccatcatttattcggtatatgatgaggcggattttcatatgggattctgggggctatcggtctcgccggtctgtcaggcatcccgatgccggcagcagccacacttacaaggcagacaacaggcaggcttttgacaacagcaaggtgtcttttgacagcagcaaggtgtcttttggcaacagcaaggtgccttttgacagcagggcggtttcggagtgcagggcggtttcggagggcaaggcggttctggcggacaggacggctttggcgggcaaggcggtttcggggggcagggaggccctggcggacagggcggttctggcggacagggtggctctggcggacaaggcggtttcggagggtatggcggctttggagggcagggtggctctggcggacagggcggtttcggagggcagggcggctctggagggtatggtggtgttggtggatacggagggtacggcggatacggtggttttggtggatacggagggtatggcggatacggtggttttggcggatacggagggtatggcggtgttggtggatacggagggtacggcggtgttggcggatatggagggtatggcggtgttggcggatacggagggtatggcggtgttggcggatacggcgggtacggtggctgcggcgggtagggcggtataggcggatacggcgattgtggagggtatggccagcaaaccggcatacatggcactggaaagccgcaggaagggcctgcattgctgctgttattgctgttattattattattgttgttattattattattgacattaactccgaactggctggatttagacgaggtaccgttctttttgccatgtttcttagagttaacacagagacagagttctgccgtgagcgtcaccggttcatcatcgaatgaggttccgatgggctggtaattcagcgcagtactctgagcctccatcgaaatcacccgtgtgattgttccggtataggatgctgtgacggtaaggcatatctgtttttggcaggcgcgcactgcgatatagaattcctgtccaatcgctggatccgcaatgggattgccgcagaaatccatgaatgtgacggagtagtcatcgccacagctgcagaacggggtgacggtaatctggggttgtccggtaaagtttgacagtattttaaaaggtccgatgagcatccgtccgcagacggtccgtacttcatccgggcatccctggaatatgaagtaaggagcgccgggatccgggggcatggtgctcttattacagcagttaatcccggcattggcgcatctgcctgtgcctgaggatggtgacgggcgggaggtatctgtggcaccgtcagcgtattccccggcgagccggagcaggttcagcacagctgtcctcaggcggtctgatttgggatgcggttctccggtgccgcagtccaggaagtacacttcatccagtgaaatctgccccagaagtacccacagggccacctggacggcggcgtaggcgtcattgtcatccagggcaggatccgcggcaggatccacaccggccagggcaaatgtggcatcggcgctgaccgccggataggtattggccataatccatccgaacatgttcttttggcgattcgtggtagcagggaagattgtctcaaagggcctgctctcataggggacatcgttgtatggaccgtcggcaaatttatctaaacagtataccggtttgttggtagaagttaaaatattcccaaaaaattggaaaatattattatggtcatcccgattgagatggtaacgggatccggaggtggtatctaaatcacagtaattttccctgttgggattgccgccagcggttccgctgatatctgaatcagggtagattataaatggtctggattgcagtcttgcattattggttttaatcacagcagatcctcctctaattcttcatttaaaagttccttacaatattaagatatgcacaagcccaggatatgtccacaaaggtatgccggggaagagggggggcatgaatcccatgataaaaggccttctatgtgcgatagaagaccttataaaacctttcaattatctgttttttcggactgcctgttcggaatggatggggctgtccggcagatgtttcccaaccataagccttacacggcatccggcaccgggggcagagcgtatggtcaccccatattccggcccatagtaaagtttgaggcgttcatccacattcttaagtcccacgctgcctaaacgcggggagccatcagccgttactgcggccggatcatagcccacgccattatccgtaaccgtgaaaatcaggcgttccccttcttcctgtacggttatcgtaacctggcctggcccgttaaggggtttgattccatggtagatactgttttccacaatgggctggaggatgattttgggtaccgtgtaatccaataagttcccgggggcatcgatgacataattcagtttttcctcataccgttccttctgtatataaagatactgccgcacatgttccagttcatcttccacggtaatcagtttcctgccgccgctgagtgacagacggaaaaatgctgccagggacttggtgagggcaatgacacggctgctgtcgttgaattcagccatccagacaatggtatccagggtattatagagaaaatgtgggttaatctggctgaccaaggcattaagctcggcatggcgcagcgttttttccttttcggatatctcatccatcaggccgcggatccggtggatcatccggttataattgccggccagcagttccacttcatagaaactgtttttgcgtacatggacttcagccagcttctcaatctcgctcatgccatgttccaagtccgcaattgggttagatagacggcgggcaaatagggtaccgaacagcaggaccatgaaaaatagcagtccgcccgtcagaagcactgcctcaaacagctgctgttccagcatccttaaggtgtctaatgataccacgccaatcatggtccatccggcattccctatccgggtctggtatgtgagccggttgccagccttatcgtagccatccccggatgactggatttccaacagctgcctctttttgtcaggattggagaaataactggtgtccttatgatagactggctcgcctttgtcgtttaagaggaagacatagccctccctgcccagatccaggctgcgcaggtgatcctcgatgacgctatattccatatctattaaaaggacgcctaagttgtcgccggaatcccctgtgatttcagtgcttacggagattacccagttgtctttgtcggaagaaaaactctgcatcctggctccggtgaggaccggcatcgtattgtggatggactcgatataccagtcttccttcatcatatcactggataccgacatatctaaattttcctcattggagaggatccgtccgtccttggacactatgacaatggatttgatataggaatcattttccagcagcgtatggatctgggacatcagcccggcgcgcaggctttcatcgtctttggacagatattgacggagcatgggattagctgcaaagacattggattccccttttacacgggcaatgtatgtaccgatgttggcgccgctcatctccagtaaatcatgggttttggagactgtctcgttcatcagcagattggacgcaaaaaagtaaacagccccgctgagaagcaggatgacagccaggccagcgccgaggaaaaagagggagagctgaataccgaaacgccggatccattcccggagcttaaatctcttttccatgtcctgcctccgtcctgaattcctttggcgtttttttgtatttgcgccggaaacatacgctgaagtaattggggtcatcaataccgaccgcagcagcaatctcatagtttttcatctgtgtggacagcagaaggatttttgcgtgttctaaacggagattgaacagataatccctgaaattctctccgaagcaccgtttgaaaagcgtacttaaataactgatgttatatcccagttctgccgccataacgctgagtgaaaaaccggaatcagacagatgctcctccaatatgccggccatctgggcgcggacatcgaaatcctcctccacgcctgtattcccagctaatctgtccacggcctgccggaccaccgccagatcatccgcctcctttttcttttcaacgagatggaagagcagcttctggatgtcatcccgggacaggggctttaaggcatagtcatccaccccgattttaattgcgcgtatggcgtagtccaggtaatcgtaaccagtgagtatggctatcttgatggacggatcccattcctttgcaagcagacagaaatcaaggccgttcatcttcggcatattgatgtctgccaggattaggtcaatatgatgtctgcggatggtatccagggcttcctcaccgttttccgcctcaaagaatccgccaatcccaaggccgtcaaaatcaataaaggcacggatgccgcggcggataaggctttcatcctcaactattagcagattatacatagcgtgtcctccctcatcattcctgtgctttttaataagtatatagcgccggagcatggaaggcaagtcttctggctccggcgctatgtttatatttttgcagctgatatcctgtatcactaattacatatcaaacatgggcttgaggaagccgtaaccttcagtatccagatcttcataggcaatgaagcggatggaagcgctgtttatgcagtatcggagtcctccaagttctttgggaccatcgtcaaagacgtgtcctaaatgggtgttccctgcccggctgcgtacctcggtgcgcaccatgttaaagctggtatcggaatcttctgttaccacttccgggatgattggtttggaaaagctgggccagccgcagccggattcaaatttgtcttcagaactgaacaatggttctccagtgaccacgtccacgtagatccctttctcaaatgtgctggcatactcgttggtataggggcgttcggtatcatttttctgggttacctgatattgtatgtcggtaagcttttccctaaggacttcatcgcttgggacgggatagtcctcgggcctgattaaactggagagattggacatacccagtccttcctcctctatgaatgcatctgcatcgtttaagtcaatatggcagtatccgcctggattcttatccagataatcctgatgatagtcttcagccagatagaagttatcaaggggcaggatttctgtgacaataggggaagtatatttttcctgctgtctgtctgccacggcctttgctatggccttgtcagcctcatccgtatagtaaatgccggaacggtactggcttccccggtcatttccctgccggttggtactggtcgggtccacaaccttgaagaaaccatccaacagctgttccgtggaaatgctcatggggtcatagacgaccctgaccgtttctgcatgtccggtattgttgtagcatacctgttcgtaggttgggttttcagtgtttccattggcatatcctacgtcagtatcataaacgcctggcagttttttcatgtaggcctcaattccccagaagcagcctcctgccagataaattgtgtgcagattattgttatccatcttatcttcctcctgttccatagacatagtatcggcggtttttactgttttacccgcaatcatggcttctgtatcctgttgggccgcaaaacagccggttaacaggaacatggcggcagtcacgatgcttatacccattgatagtgtccgatgatttttcataatccattctcctttccatgacggttattttatggattcaaaggtgaccctgatggtatcattatctgcatggcccggaaccaactgaaccattacaccgtcggaaccaatgtattccgaagtgggatagccgcgcacaccggtctgtgtcccataggttccgtccatatcaaacagtactgtgatgtcggcggtattctcaacaccggaaaaccatgtcttaaaatccgcggtgttcttttcacctttctgtccgggggcaacaatggttaagaccttaaagccgttatcttcagcggagagggtattgatatcctccagaccgcctaaacagatgggacaccaggaagcccaatattttaaataaactctttctcctttgaaatcagaaagtttaaccgtattgccatttaaatccatcatctcgaagtctggggccggttttcccgtattcattttttcatttccgctcatcgtatcaggaccctccatcatcccggtttcctgtgtttccatggtttgactggcggcagccttgacgtctgcggtatttccggcgccgcaggcagttaaggagattagtaaaaatatagaagctgcacctgctattaaattcttcctcatagtattccttcctttctcaagtgttaaccaaagatagccagtatgctgcccagataatccgtcatcagtaaaattcccatcaggattatgatgatgcctccggcaatcttaattttcccaagatacggattaagcatttttacctttgtcagcagtgtatcggagaagagggacagcgccaggaacgggatcaggaatcctaatgagtaaacagccatcaggaaagcgccatacagcggctggctgctggtggcggacagacccaggattgctcccaggaccggaccgatacagggggtccagccaaagctgaatgtaagacccaataaaaatgccccgatgtagtcacccctgcgggtgcgttcccaatccacttttttctcatggtacagccacttgatatggatcagtcctgtctggtgaagcccaaggatgattacaataaggcccatcacggtcaggaaggatttactgctgatgactgatcccaatgcccctgcgccgaaccccagaaggatgaagcatacggatatgcctgcaacgaaaaggacacttttaaggaatacccggaatttcctcctggaggtaccgtcatccccggcggttttgccggaagaaaacagggatatgtatacgggcaggagaggtatgatgcaaggggagaagaaggaaaaaagtcctgcggcaagcactgtacctaagtaaagtatgtggggattcatgttgtcacctctttcttaatttgatgactttattttactttttttaaactgtgattggaatggaatggctttggctttttctttgatttgtttgggtggggtatggacgctggatccacggcggggaaggatggctggcaggtgagcgaagccttaagaagtgatatgtcaatatggtccgcggtgaagaccggataagagactttaaaagaagcagttaaaaggataaaaatcagaaatgaaaaagaaacttttgtttccgataagagatattatcacgagttgggttatgatatattccacttattttatcgacatattttgcagttttataatacaatttatcatgtatatataaaaaacatacgattatataagtgtgaaatattcatttcgctaaaaccatgtctgataacatggttgataatcctaaactgcatgcagtactttatcagcctgcatggaatacagtttttcctaggtcgtgtgtgtgtttctttcactattaatctaatgataatatctcttacaagcagcattacgtaaaaatttgtagatagaggatggacagatatccatatctccaaagggcaggtggaaggagggcatgaattcgtcataggaattatcagtcatgagtagggaaatatcaatggggaacggcctatcctccataaagacccggctaaggaaagcagaaggtacgggggtggctggcaaaaatatttaaactattagataaagtggaggcttgatatgaaaaatttaaaaatagggaagaaattgataatatcgtatgcagtcatattaattcttcttataaccggtaccattgtaagcataatcaatctcaatagctttggtacccaaatagagactttttataacggaccatttacggtcaaaggaagcgcaaacatcatcaacaccaactttgaaagaatgcagaaggccgtttatcggtccatggccaatacagatatggggataacaaatgaggcattggaagatgtcaaggaggctgcggctgcaatacaggaacagttgcctatcgtaaaggagcatttcatgggggacccacagcttgtaacccggctgcaggaatccctgacgaagcttgctccaatgcgtgaggaagtgctcaaactgtcttcagaaaataaaaacgatgaggcggctgcttatatggaagccaataacattgtggtcatcaaggaagcgcagaaagaattggatacccttatagcgagcggaaacgaaaaaggggaggaactgattgcaaacctggaggctagccagataagggcaatcatcatattgtccgtactggggtgcttgagcgttactatcagtatttcatttgctctttacattacccgtgggattatccgtcctgttaatgagcttgaacatgcggcccagaacctggcaagaggaaatctctcctccacgtcaatcgattatacctcacaggatgaactgggaagtcttgcggataacatgcgggaagtagtggcgtccctcaccaatgtcatacaggatgaggcgtatctgttaaatgagatggcaagaggcaattttgacatacaaagccgtgccgaggaaaactatgtgggggattttcagcaggtatatgcgtccatgcggcagattgtggaaagtttaagccaaacccttcttcagataagccagtcctctgatcaggtggcatccggttccgaccaggtatcatccggtgctcaggcactgtcccaaggagccacggaacaggcatcctcagtggaagaactggcggctacaattaacgagatatccagccaggtggaccagaacgcgaagaatgcacaggaagccaatgagaaggcaagaatagtaggggataaggtagaagagagcagcaggagcatgcaggacatgctgtccgccatggcagatataagcagcagctccagtgaaattgggaaaatcatcaagaccattgaggacatagcgttccagaccaatatactggcattgaacgcggcggtggaggcggcccgtgcaggcgaggcaggaaaaggctttgcagtggtggcggatgaggtccgcaatcttgccagtaagtccgcagaggcatccaagaataccgctgccctgatagagaattcccttcattcagttgagcgtgggaaatccatagcggatgagacggcgctttcgctggcggatgtggtaaacggggtcggggaagtgagcacgacaattagccagattagtgaagcgtctgtccagcaggcttcctcaatccggcaggtgacccagggaattgaccagatttccagtgttgtacagacgaattcagccacagcagaggaaagtgcggcggccagtgaggaattatccggccagtcccaattgctaaagaatctggtgggccagtttaagctgaagatggtggatgaaagaaaaaatatacataatatccatgatacacagccacaggaggccaggataccggaaaccggcgtcggaaaatattgatacaacattattcctgcagctggaggtatccctgctttagccttccgggtccctatggaaagcagtataaggccaaaaaaagaagcattcccctgcttctccctaaatatagacaaccggctccctaaaaggaggcggttgtcccttttccctttatcctgtctttctatttatatattatatatagtgttcctcaaatttttccagcgggacaggggggctgaacagatagccctgtatcccgtcgcatcggatctgttgcaggagcttcagctgttcttcggtttcaactccttccacaatcatttgaatccccatcttacggcatagattggatatggagtataaaacagcctgtgctttttcattatgggcaaggttatggaccagacatttgtcaatttttaatatatcaaaatccatggaagtaaacagggacaggttggcatttttaatgccgaaatcatcgatggatatggaaaaaccctcctgtttgatttttttcattaattcgatgaaatcaaatctgtcatcttcctcaactgtttcagtcacttcaatttcaaggaactgtttcggtacctggtattcgctccatatttcctttattctattaagaaagttatgctctgataaggtataacgtgaaaaattaactgagacaggaataatcctccttccttcgcacatccatttcttaatctgtgcatttaccatgcggaatatatggaagtccagcacgctgatcagccgtgactcctctaaaatcggtatgaaattgttgggttgaattatattaccgggagaaatctcacatctcactaaagcctcagcaccgataaaaacataggtgtttggcgaaaccttaggttgataatagacaggaaatttattgtcctcaatcattttcgttaaaacaccgggttttgtcaggttcaggacatcatccagaccgtggcggtaacgtcctgacagtgcacggccacggtaaaattctttcttatcctggtacatcagttcatctgcacggaacaggacgctgcggatatctttattatcctcggaccagtacttaccgatggatacagagtattctttctcagacatgaacgactgcctgagctcccggacttttgtctcaaatgattcctcacagataccctggcatattaccacaaattcatccccgccaatccggtataaataatcgtctggaaataaaagcccgattacatttccggtatgaataagggcgatgtcgccgtgattatggccatactcatcattcatccgtttcatcccattgatatccagatagataattcccactggctggctaccctgttccggaatccgactgatatccaggttgaatttattgcggtttcccaaatcagtcagagaatcgtaatagcttaactgttccagcatatgaagggacttcatgatttcaaacttcgcacctacgaaatatccgatggaaccaagaatggcttgtgcattggcaagcttctgagtggtatagttatctacacctatatacccggacagcgtgttatttgaatatattgggactgcaatcatggaacggattccctgccgtttaagctcttcatattcatccgcgttttccgttccgacctgttccacatcttcaatcaacacacactcttgccgtttgaaggcatcctgccaccgttttataagtgtaaccggcatatcctggagctgctctatctgaggctcaatgcctttagcgcaccactcatatgtattactcatggtatttccatttatttcaaagatataggccctgtcggattcaagaaaggaacctgcgatggaaagcacatcgtcaacatgatctttttcataggaatcggcaaataggatctgtgcacatttggttaccaggttttctgctgcaagggtatttcttagattgattttttcaatttccccatccgtggtatcaaacgcaatctctacacgcgcttttttcccttcccagtcaatcagcttgtctttaagcagataatgccgatgtacaagggggttggtatattcccaggtgatgaactgttctggcttcaagagggaattcgtgcaaaattcgcatgggtatttttttccttgaagcgcacgataacatttcataccggatatatcatccagactgaatatttcctttccggattggtttacgaacagcagatcatatgtatcaatatcgaccacataaatcagctcggacatttcatttattaaatcaatcatttgggaatcctgcctttcattggtacattattctgctgcgccaggaatggggcagccgcgattctggactttcaggtaattttcatatgcagtccgtatgaactgttcatcgcctgttttttccggcggtatatatggtttcccctcttcacgctttcgcaggttgaaccgcttcatttcctgacggatgatgtctgcatgggaggtcatttcccttgtggcggctgccgtctgctggctggtagcggcgttagaggagacagatgaggagatggtctgtatctccctgtaaatctggctgatatacgcctgctgctgtccggaagcctcatggatgccgtcaatcattttatatacctggtcagactggtccactatggagtcaaaggtttctgatgcttcatgggatatccggctgccttcatttgcctttttaatagtatcctcaatgtagacccggctctgttttgcggcctccgagctttttaatgccagattccgtacctcttctgcaaccactgcaaatccttttccggaagcaccggcccgggctgcctccacggcggcattgagtgccagtatattagtctgaaatgcgatattatcaatggttttcaaaacagtattgatttttccggaggcagtctggatttcctgcacggcacttaaaagttcattcattttatcttgcccgaccactacctgggcatgcattgtatcaattacatccttggcaaagtctgcattacctgaattgtcctctgccaactggttggcctggttcatggtgccggacagcttttccacggcagcagcctggttggttgagctgacggccagttcctggctggcatctgagatatatcctgcactttgggccacggaatccgcaatcctcagcaaattggcaaacatgaaatcattgctctggaccagatggtagagattcttgcccaaactgtctccctgggaacgtatatccacataggcggtcagatccccttcggccaccttctggattacacgcacattgtcacggatgctgtcagccagggatttaaaggaattgaccatgcggataatttctacggtattgtattgttgggtcatatctgcttcgtccaggttcagattgtcaaccccggttgaaaatgcctcggaccagttggcaactgtgaggatggggatggatatgcgctttgcgaccctgcggccgactatcagggaacttatgacagaggatatgccaatcaggaacaacatggttacacacaggctggaggtcgcctctgtctgcttttgaatctgtaccacctgcttctggtatgcttcactgatggccgtaagcccctggcctatcttttccactttcggtttgaagttttcactgtattcctgataggcggcatccctgtcatgtctgcttgtctcgattaactgtgaggcctccagatggatttcgcggtggggctgtacaatcttatcggattcagctttgattgacggatattttaataaatcttcccgggaacggttcatccattggccgagtgcgcatccgtccgggtccaggctgccctggaattcggttcctgttgtaatggaatcacttaactgttccagccatttgtaatgggctgaaatcacctgttgggaggaggattgctggttttgaaaggccatgatatgaccatagctcctgttcgtaatgctaagaaagatggctgacagaaggaccagcaggaccagaagccctgaaagaaggatataaccttttgtaatttgcctttgaatggtattattgcgcttcataagttaattaacctcctgaaaaatattttttaaggaaattgtgaaaaactgcagacactgtgccgctgcagtatatataggattttgaaacgctattcaaaactttagaattctcatttgcagggtcctccatttcttgttaaagtgggtagtgtgaagggggaatgaatcttcccataatgcgtattatcgtcataaatatcatccaaatttaaaaaatatatttgattttagtggcctcttcattcctcgccacatacgcttgaaaataattatttattttaggacgaaaagtttatacattggagaatattgtcgatatattatggagtgtggtgtacaggttatccatataaaaatgatttattttatctgataatacgcattatgggaagaaaaaatcacacacgacaaattattgaagctaaaaaatcatatttaaggcgctacccattcatatggaatggagtcatgcatcagactgtaggcaacttatctcttaaaaaggggcagttgtcttttttctatcatcttatttcccatatagcacaatcattgcgatatgaaaggctgtttatcttatgtatgacaggaataaaagaactggaaaaatcaatgatagccggatgaacagtggaagaaagtaccgatatatagagtattttggtggaatgtggtatacttatcatattcagtattcttccctctgaaggattcaggatatggttgtgaattccacagtcttttcaggggtatgttctgccgaatagtgttgcttaataccgtgaaatgaattataattatgcattgtggcagattgtttcgtcccgtgtcatgtagctgggattaaaaatctttgtattaaaaaagcctgatttttagaaaaaggggtgaaaaaaggagcaaagaagagcagttcaggacacaggtccggcttcttttcaattcataccggcctttactataaatcaaaaatactgtgtaaaagcacaataaataaggaaaaatcatgagaaaactagcattaaatgatgaagtgttactgagcattcagcagcctgcccgctatatcggcggtgaggtgaacatggtgaataaggaccccaaaaaagtggatatccgctttgccatgtgtttccccgatgtttacgaaatcggcatgtcccacctgggcatccagatcctatactccatgttcaaccagcgggatgacatatactgcgagcgtgtgtattccccatggatggatttagaccccatactcagggagaagaagattccgctgtttaccctggagacccaggacccggtgaaggattttgatttcctgggaattaccctgcagtatgagatgtgttataccaatgtgctccagatactggatctgtcccagattccccttcacgcatgtgacaggacggaggagcatcccatcgtaataggcggagggccatgcgcctacaatccggagccgttagcaggattttttgatatattctatattggggaaggtgaaaccgtatattttgagcttatggaccgttacaaggaaaataagaaaaaaggcgggaccagacgcggtttcctggagctggcagcagggatacccggtatctatgtgccggcattttatgatgtcatttataaggaagacgggaccattgagagcttcctgcccaataacagccatgccacgccggtggtgacaaaacaggtcgtaagcaatatggatgacgtgggctatatagaaaagccgctggtgccttttattaaggtgacacaggacagggtggtgctggagatacagcgcggctgtatccggggctgcaggttctgccaggccggggatgtgtacaggcccctgagggagcacagcctggaatacctgaagcgctatgcctatgatatgttgaagaacaccggacatgaggagatatccctgagttccttaagctccagtgactacagccagttagaaggactggtgaatttcctgattgacgaatttaaggggaagggagtcaatatctccctgccgtccctgaggattgacgcattttcactggatgtcatgagtaaggtgcaggatattaagaagagcagcctgacctttgcgcctgaggctggttcccagcgtttaagggatgtcatcaacaaaggcctgaccgaggaggtaatcctcaagggggccagggatgcctttgagtctggctggaaccgggtgaagctgtatttcatgctgggccttcccacggaaaccgtggaggacatggaggggattgccctgctgtccgagaaaatagcagaagagtattatgagataccgaaggaccagagaaatggcaaggtgcagattgtggccagttcctcattctttgttcccaagccctttacccccttccagtgggccaggatgtgcaccaaggaggagtttattgagcgcgccaacatagtccgcggcaagttccgggagatgaggaactataagagccttaaatacaactggcatgaagcggagctgactgtccttgagggcgtgctggccaggggcgacaggcgtgtgggcgccgtgattgaagaggcataccgcacaggagccatctatgattcctggtcggaatattttaacaatgatatatggatgaaggcatttgagacctgcggtgtggacatcggcttctataccaccagacagcgcagcctggacgaagtattcccatgggatttcattgatgcgggagtgaccaaggagttcctgatacgtgagtggaatgccgcggtcaatgaacaggtaacgcccaactgcaggcagcggtgttccggctgtggggcaaaatcatttggcagcggtgtctgttatgaaacggtaaagggataatatatgaaaattcggattaaatttaaaaaacacggtacaatgaaatttatcggccatctggatgtgatgcggtatttccagaaggccatccgccgttcaggggtggatatctgttacagcggcgggttcagcccccatcaggtcatgtcatttgcagcgcccctgggcgtggggattaccagcaacggggagtatgtggacatagaagtacagggcacggaggattctgaatccatggtttgccgcctgaaccaggtcatgtcggaagggtttgagattgtcagttaccgggaattgccggatacggcgggcaacgccatgtccattgtggcggccgctgactacagggttgccttccgtcccggctatgagccggagggaatgacggcagaggactggttcaggggtctggtggatttctatggacagcctcaggtgattgtcaccaagaagaccaaaaagggacaggctgagctggatataaaacccctggtctatgagctttaccttgaccgatgggaggaaggggaccaggaggaaggaacatccccgcatgaaaaggaccggccggcccttttcatgaaaatctccaccggaagttcctccaatataaagcctgatctggtgctggatgcatattatacccatctgggcctggaacggccggatttcgcttatctggtgcagcgggaagaggtatatgccgatatggcaatggatgcgcagaaagaaaagggaagccatgagtttgtatcactggaacagttggggcaggaaatattgtaatggacaggctgattgtaacacaattgaatgacagggtatgtacggctgctgtatccggcagccgtattacccagcttatgatggagccggaggattcctcctccctgttaaataacatatatatcggcaaggtccagaaggtggtcggcaatatcaatgcggccttcgtggacataggcggtggcaggacaggctattacagcctggatgaaaacaaggagcatctgtttgtctcaccctccacagggaagctgaaagccggggatgaaatcgtggtccaggtaagccgggacgcggtaaagacaaaggcgccggtcctgaccggaaagcttgcatttaccggcaggtactgtgtacttaccgctgggaagacgggagtcggtttttccaataagataggggacaataaatataaggcaagggtcaggagcatgttgaatgaggccctggcagaagacggggaccggtttggcattattgtgcgcaccaacggggccggtgcagcggatgaggtgcttttgcaggaatacaggcagctgaaggatatgtatctgaaactgtcaaaagaagcgtcctgccgtacctgttacagctgcatctacagggcattgccgggatatatcgcggcgatcagggactcctacagcggcacactggatggaatcgtgacggacatacctgcctattatgaagaactaaaggattatctggaggaataccaggcagaggacgcggataagctgaccctgtatgaggataaactgcttcccctgtccaagctttacagcctggattcagcccttgaacacgcccttaacaagcatgtgtggctgaaatccggtggataccttgtgattgagcctacggaagccatggttgtcattgatgtgaatacaggcaaatactcaggcaaaaaaaagatgcaggacaccatatgcaggattaatatggaggccgcagatgaaatcggacgccagctcaggctccggaacctctcgggaatcatactcattgattttatcgatatggagcgggaagaggacagggaaatgctgatgcgccatctgggggacgttgtttcaaaggacccggtcaagaccacggtggtggatatgaccaggctgaacctggttgaggtgaccaggaaaaaagtgaggaagccgctttatgagcaggtctgaacataaaatatcacacaaaggagcaaaaggggaaggaaaatgaaaattataattgttggatgcggcaaggtgggaaccaccctggctgaacagctgaacagggagcagcatgatatcacgctgattgattcggatgctgaagcgctgcaggcagtggctgacagcatcgatgtcatgtgtgtcacgggaaatggcgccgtgtatcaggtacagatggaggctggtattaaagaggcagaccttctgattgcaaccaccaactcggatgagctgaacatgctgtgctgcctgattgccaagaaggcaggaaactgccacaccattgcccgtatccgcaaccctgaatattcagccgagatcaattatatacgtgaggagttaaacctgtccctggccattaacccggaactggctgctgccagggaaattgccaggctgctgcgttttccaagtgcaatcaagattgagccctttgcaaaaggcaggattgaactgctgaaattccagattccccagggttccatcctggacaggatgaaggtgatggaggtggtcagccggttaaaaagcaatgtgctgatctgtgctgtggagcggggcaatgaggtggtgataccggatggaaactttgtcatgctgggcggggataaaatctcattcattgcgccccactctgattcggctgagttcttccacaaggcggggattgagaataatacggttaacaccgccatgttcgtgggcggaggaaggctgaccgtctaccttgcaaaggcgctgaccggggccaagataaagattaagatcattgagcaggatgaggagcggtgccggcttctcagtgaactgcttccggaggccatgatcatccacggcgatggctctgaccagcagcttcttctggaggaaggcatccgccagaccgaggcatttgcatccctgaccggttttgatgaggagaacatcatgctttccctgtatgcggccagccagtcaaaagccaagctgattacgaaagtaaacaagattgcctttgagaatgtcatcaattccctgaacctgggaagtgtgatttaccccaagatgctgactgcggacatcatacttcagtatgtgcgcgccatgcagaattccatgggaagcaacattgagactttatacaaaatcgttgcggacaaggccgaggcgctggagttcagggtgagggaggcatcgccggttgtgggaattccgctggaggacctgaggactaagagtaatcttctggttgcatgcatcaaccggaacggtaaattcatcactccccgaggcaaggatacaatccaggtaggggatacggtcatcatcgtgaccacacacacagggcttaacgacttaaaggatatcctgaagtaaaggcgggctggaaatgaatcggaatataattatgtatatgctgggctggataatgaacattgaggccctgtttatgatgctgcctgttctgacagctgctgtttataaggaaaacatcggttttatctatctgggggtggcggttgtatgcggactgttaggcattgcctgtaccaggaaaaaaccgaagacgaaaatgttctttgcaagggaagggtttgtgaccgtatcccttggttggatagtattgagttttttcggctgtatgccctttgtcatcagcggggaaataccgcatatcattgatgccatgtttgagatcgtctccggttttaccaccaccggatccagtatcatcccaaaggttgaggatttatccaaggcatccctgatgtggagaagcttttcccactggattggcggcatggggatcctggtattcatccttgccatccttcccatggcaggggattataatatgcatatcatgcgtgcggagagcccggggccttctgtgggaaagctggtgccaaagataaggattacggccaagcttctgtacactatttatttctgcatgacgattgtgatgatgattttgctcctgatagggaaaatgcccctgtttgacagtatctgcatgagctttggcgcggccggtacaggaggctttgcctgccgtaattcaggacaggctgattataccgtgtaccagcagggggtcattaccgtgttcatgctgctgtttggcgtgaactttaacgtgtactatctgatgctgatacgtaagccaaaggatgcgttccggtgtgaggagctgaggggatatctggccattgtcgtgattgccatcctccttatcaccattaacatacgctcccttttcccgagtctgttcatggcattccaccaggcggccttccaggtttcatccatcatcacaaccacgggatattccaccattgattataatgtatggccggaattttccaagagcatactcctgcttatcatgttcatcggcgcctgtgccggaagtacgggcgggggtatgaaggtatcccgtatcatgattgcatttaaagaaatcaaaaaagaaatggcatccgtcatccatccgcgcagtgtcaaggtactgaagtatgaaggaaagcccctggaacacaacaccctgcgttccctcaatgcctatatcattgtgtatttcatgatatttgcaatatctacgctgatcatcagcctggacaattttgatttcatgacgtccttttcagcggtggctgccaatttaaacaacatcgggccggggatgtccgtggttggtcctgcttccaactattccatgatgtcctatctgagcaagaccgtgctcatattcgacatgcttgcaggaaggctggaactgttccccatgctggtgctcctgtcaccgggaacctggaaacgcagctgatgcagtagggattggcggtatcacaggattgcatgtaattgtgaaatgtaagtgaaaaatcagcggccttccttgactgatcctgacgggtattgtatgctttttttatccatggattaaggagggatgcagttgacaggaaaaactggaatacggatccgaaaagggattcacaaattaatatacgccgtaagcgcgttcctgctgtcagcggtgattgccagcgggacagcggcagcgcagactaagggaaatgggcaggatgctgccggtgaaggcctggcggcgtcaggatgggaacaagagggattaccggatggacaggctgcggcagatccgggtgcggacggacagattcaggcagatcttgacacggacggacagatccaggcagaatcggggacggcaggacaggccgcggcagaagcagtggccggacaggaggacatacctgagatatatgggcgcgggagctatgtcatcggacgggacatgccccctggcgagtatgccgtgtttacggaagatacttcggggaaccgtgcattttcctccagcacccttactttatataagaatgattcagatgaaaagaagattggaaccttccgtttccagcaccacggcctgattaccctttataatggccagcatctgatcatgtcaaaggggtacgcagtactggcggaccaggcaggcattacccccggacccacaggaatgtataaggcaggacgtgatatggagcctgggacctaccgtctgacgccccttacatccgacggcgcccactatgccttgtataacgacgtgcgctattactatgattacatggacgattaccagaccttcttccagccggtggaggtaacggtggcagaaggacagtatatagaactgatggatgtcagcgcaatagaaaaagtaaattagctgaaaaatagtggaaattcctgttgacatcagcagatggaaatgctattataatcaagtatgccgcacagcgaggttctaagattctgcccatttgtctgaggacagggaagcagggacaccgaagctggcgagtaatgattataggaggtgcctttcatgtacgcgattatagcaacaggcggaaagcagtacaaggtagcagaaggcgatgtcattaaggtagagagactgggcgcaggcgcaggcgagaccgtaacatttgaccaggtgctggttgttaacaacggcgagctgcagattggatgcccaaccgtatccggagcaactgttacagcaacagttgagaaggaaggtaaggctaagaaagttatcgtttacaagtataagaggaaaactggctatcataagaagaacggccacagacagctttatacccaggttaagattgacaaaatcaatgcttaatcgtaaatgatatgattaaagcaaccgtattaaaagattccacagattcaggcaatgtcatctacaggggaatcgtgatggagggacatgctggttatgcagaggaaggtgaggatatcatctgtgctgctgtatctgcattagccctgaacttttttaactcggtggaggcatttacggaagatgaatttgaaggcggggcaggccaggaggacgtacagttcgaattttgcttcacttcagatataagtcctgagtcacagctccttatgaattctcttgttctgggattacggaatattgagaaggattacgggaaatcatatattaatgtcaagtataaggaaagtccacgataaaatacatcgtggaaaagcaaggaggtgtaacacatgttaaagatgaaccttcaattattcgctcataagaaaggtgttggttctaccaagaacggtagagactctgagtcccagagacttggcgccaagagggctgacggacagttcgtactggcaggcaacatcctgtacagacagcgcggaacccatatccatcctggcaacaacgtaggcagaggtaatgatgataccttatttgctttagtagacggagttgttaagtttgagaggaagggcagagacaggaagcaggtttctgtatatccaagggcaatcaacgaataatttcgaagggctccatacttggcgtatggagctcttttttcttcaacgggaatatcctgttggggacaacaccacaggaggtgctatgtatgtttgccgatagtgcaaaaatatttattaaatccggcaagggcggagacggtcatgtgtcattcaggcgcgagctttacgtccccaacggcggtcctgacggaggcgatggaggacggggcggagacgtcattttccaggtggacaaaggtaagaacacactggtggatttccgccatgtccgcaaatacattgccagggacggggaacagggcggcaagaagcgctgccatggagcggatgcagaagacctgatagtaaaggtgcctgaaggtaccgtgattaaggattttgaatccggcaaggtcattgccgatatgtcaggggataaccagcgggaggtaatcctccggggcggcaagggcggccttggaaacatgcattttgcaacatcaaccatgcaggtacccaaatacgcccagccggggcagccgggagccgaactgtttgtacagttagagcttaaggtgattgcggacgtgggactggtaggatttcccaatgttggaaagtccacactgctgtccgttgtgagcaatgcaaagcctgaaattgcgaattaccattttacaaccctcaatccccatcttggcgtggtagacctgggggatggcgccggttttgtcatggctgatattccgggccttatcgagggggcatccgaaggcgtgggcctgggacatgccttccttaaacacattgagcgcactaaagtgctggtccatgtggtggacggcgcttccgtggagggccgtgacccgctggaggatatacgtaccattaacaaagaattggaggcatataacccggaactgttaaagcgtccccaggtcattgccgccaacaagatggatgccgtgtattcagaggatgattccaatgagatactggatgcgctgagggctgaatttgagccaaagggcatcaaggtatttgccatatcagctgtcagcagacagggggtaaaggaactgctttaccatatcaatgacctgttaaagacagtggacgatgcaccggttgtgtttgaaaaagaattcgagattgagtaccagggtgaccggaaccttccatatactgtttccaaggaagaggaaggactttatgtggtggaagggccaagaatcgagaagatgctgggatacaccaatctggactctgagaaaggctttgatttcttccagaaattcctcaagaatacaggaatccttaaggaactggaagaggcaggcatcaaagaaggggatacggtccgtatatatggactggagtttgattattataagtaaaaggagttaatatgacgagtaagcagagagcctatctcaaaggcctggccatgaatattgttcctgtgttccagattggcaaatccagccttacgcctgaaatcacacaggcagtggatgaagccctggaagccagggaactgattaaaatcacggtccttaagaactgtctggacgatggcaggtccattgctgaggtattggcagagcgcacccattcacaggttgtgcaggtaatcggcaggaagattgtactttaccgtccggcaaaggaaaagtcgaaacgtaaaatcgtgctgcctgaaaaataagggagagggatttctatggcaaggataggaattctgggcgggacatttgaccccatacacaacggtcatctggaactagggaaaaaggcatacgaggaattcggactggaacatgtctggttcatgccttccgggataccgccccacaaaaaggatcataggattacagaggggaagatgcgccgggacatggtcctgctggcaatcgcggatatcccctgttttctgtattcggattttgaaatggagcggaagggcaatacttatacggcccagacccttacactcctgaaaaaggagcgcggtgaggatgagttctattttataataggcgcggattcactgtacgaaatcgaacactggtatcatccggagctggtgatgggacaggccgtgcttctggtggccgggagggcatacaagaccaggcacaggatcatggaggagcagattgcctatctttcccataagtacggcgctgttatttacccaatccactgtccgcagatggatgtgtcatctgagaaaatcaggtccgcggtggcggaggggctgtcaatcagcggtctggtgccggagcctgtggaggaatacatccggtcccatggattgtataccgataacgtgctgcaatgccagtatgaggatgtgtaaggaggattatatggagacacaatgcagccagatcatgatgatgaggaaaaaactcaagtcaagactggaccccatgcgctatgaacattcactgagtgtgtcatttacctgtatgaacctggccatgcgctatggttatgatatggataaggcggaactggccggtttgatgcatgactgtgggaaacgttattccgatgacgtaatattgaggaaatgcctgaaacacgggattgaagtgacggaggatgagctgaaggccttgccggtccttcacgcaaagtacggcgcctggctggcagaacataaatatcagataatggaccgggaaatcctggacgccattgcctgccatacaaccggtaaaactgatatgaccaccctggataaaatcctctatattgcggattacatcgagccaaggcgttataaggcggagaatcttccaatcatacggaagatggcattcgaggatttggatgacaccatgtatgccatcctgtccggaaccctggaatatctggataagaagggcgggaacatcgaccctatgaccgtagaagcatatgaatattttaagaggctgaaaggagacagcaatgaactcaaaggaaatggttaaactggcatacaaggccctgagcgataaaaagggggaggatattaaaatcatcgatatccagtccgtatcggtcctggctgactacttcatcattgccgatggaagcaaccccaaccaggttcaggccatggcggataacgtggaagaaatcctgggaaaagagggctgtgagtgcaaacagattgagggctatcagaatgcaaactggatcctcatggattataaggatgtgattgtccatatcttctgtaaggaagacaggctgttctatgatctggaacggatctggagggatgggaagacgtttgtggacgttgaggaactgtagtcttgagagggacgcaagggaagagggaggccgagggagggcgcagaccgtcctgccctggttcctggtttccgcggtgggccggactaaggggccgggatgcaaaaacagaaggttcgctgccaattacggcgcaggcttgatgcctgcccctccatgggcagccggatttgggcgtggagcgctccaaatccgccttctgtttttgcatcccgccccctaagtccggccgaaccgctccaaatgtcaccaggacaggacggtctgcgccctccctcggcctccctcttcccttgctgtgtattggcggcagctgggattgggggtttgtatcctgtttccatatggttcatggatgatttggcttgagtgaaggcggatggctgtggggatgcaggattctgcttttttgttatgtgttgttttgaaggatggtcgcgatagggttgaaaaagaggaaagagggttgcaggaatgcagccctcttttaaataatctgaattattacatctaaatcatgaaatacaaatcattaacctaattaattacatcatacgtataaggccgattaccttgcccagaatctccacatggtccgtgatgatggggtccatggcttcgttttccggctgcaggcggtagtggcctttttccttgtaaaagcgcttgacggtagcggagtcatctaccagtgccactacaatctcaccgttcaatgcagtggggcactgttctatgatcagctggtcgccaggcaggatgccggctccgatcatgctttcaccctttacctttaacatgaaggtctctgcgttgggaagggcctcggccgggaatgggaagtaatcctcaatccgttcctctgcaaggatgggttccccggcagccaccgtgccgatgagcgggatgttgaccatctcccggcggttgaagttgaaggtgtcatccaggatctcgatggtccttggcttggttgggtcgcgccgtatgaatcctttttcctccagcgctgagaggtgggagtgcacggaagatgtggactttaaatgaactgcttcgcagatctcacgtacagcgggcggataccccttcttaagtattgtttcttttatgtattctaatatctcctgctgtttagaagtaattttatcctgagccatattcaacctcctgcattttctattcttatagtaacatatgttcgggtaaaatgcaaacctttgttcgcttttttgccggaaatccattgacaaacatgtgttctggtgctatattatatacatacgaaagaacacatgttctgtagcgcgcgcataacggaaccgccttagggaggttgcatatgagaaagttaatggttaagttagtggctgcctgttttgctgtacttttatttgtcaccattttcatggggcgtactatgtttacctccatggcaaaggaggagagcggggccacgccgtattataagagtgtccagatacaggaaggggacagtctgtgggggcttgccagccagtataaggatggaagctccatgagtacccatgagtatgtggaccagctcaggcagatgaacagccttaagaaggataccatccatgcgggacagtatctgaccgttgtttattataagtaggaaggcctgttgtttatcataggattacaggggattggttgttccctgcagacagaagtgcatggaagcgcatatttgtctgcaggggctttttattttcatgattccataaggaataacaggtctgaatgaacggcatggttcatagagtggtataatgcgggtcaggtatgacgtgaggcaccggttacatctgcatataattttctggagtttttagtgtgattataacaatttttttaagaagcgttaaaattgtataaagaaagaaataagatgcagataaaaataacacaaatattatagcggaatcttattatttattgttcaaatttaattttgataactttaatattattaatttataaataatatgtatttgaaattataaaatacagtgactataatagggcaatgcataagagatgagaaagggggttggaagatatgagtgatttagtgggatcattgatggaggagcttaactgcaacgtggtgtttaccataccgctgtttggcggtattcccatacttgaatcggttgtggtgacctggatcatcatggcggtcctcatggcggcgtccctgcttctggtccatggcctgaaggtcaggcagatcaacaataagcaggcggccctggagagcggtatttcctttatctatgacttcttcgaaggattgctgggcaaggacggcagggattacataccatacctgattacagtggtgctttacatcgggatagccaatatgatcgggctgtttggatttaagtcaccgaccaaggatctgaatgtaaccgcatccctggctgtcatgagcattgtgcttgtggagacagcgggaatccgcaagaagggcgtcaagggctggatcaagagctttgcggagccgatacccatcatagcccccatcaatgtgctggagcttttcatcaggccgctttcgttgtgtatgcggttgttcggcaatgtattgggagccattgtggtcatggcgcttatcaagcatctggtgcctttggtggtgcctctgccgtttagtttttactttgatatatttgacggggtgatacaggcttatgtattcgtattcctcacgtcactatatataaaagaggcaattgaagactgaggtaaaggctgatggcttcaaacggaatgaaaatttttataaaaaaacttactaaatttctgattatcttttcataagttggtaaatgccgatatatcccgtattttagggctttatcggtattttctttttggaagataccttgcataagctggcatttaccagcatgaaaatgcaaccaaaagtagtaaatgagtagtaaatataagctccgatattaacaagccagtctttccagttccgcttttgcagattgaaatgtaccgtgtgcgtaatagccaagtgtcatggttatgttagcgtgtcccatgagatattgcagggtgtttgggttcattcctctatttgccatattcgtacaataagtatgcctgaatgaatgtggtgtgatgttcggtaacttatccgtgtgatacttgttatatttcttaatcaatcctcgcaccataccctcatagtttcctgcaactttaggcaagccctcacggtttaagaataggaaattgctgtaaccacctacaatcagcggttgtgcttttcctctgctctttagtattctttggattgcttgataagcccgttctgtcaatggaagttcccgttttccgtttttggtctttggtgtttcaatatagtagcctatttcgctatctttcaatagctggtggtctatattgagtattctgttctgcatatcaatatgcgtcgtcagtccgcaaaattcagaaatacgaagtcccgtttccagcagaagcacaacctcatcataatacttgctgtaaatcttgtccttttccataaaggcaagcaggcgttcttcctgctctggtgtaaggataactttctgctccgtatcatcttccagaacatcacttagcttaaattcaaacgggttctttctgatacagtcgtcttgtatcgccatgtaaaatgacgctttcaaggaacgcttatagttatcaatcgttttataggcatatcctttttcactcattctgatagcccattctttagcgtccgattgcttcacagtatcaatcgccctcatacccaacgggtcgtttttcagagcgttcataagatactgtcgtcctttttcagtagcccttttgatgttctttctttggctgttcttcttgtcgtagagctggcagactgtcattttaccgccgactgtgtcgataccgtcgttaaggtctttttttatctgtgcttctttttccctcaacgatatatcatcacgctttccagcaggtgtcttgtctgtcggtacaagtttccaagaatagacaaattgtggctttccgtatatatcggtatatttataaacgtatcttccgtcttttcgctggctctctccattacgcaaattgcgatttttaccgtcttttcgttttacattagacatagtgtaaagctcctttccgtcatggaatgagccgtgatacgctatatttattataccatatctacggctcaatgacattagatttcgtccaatgtatctatgattttttcaaattgttttcgcttaatctgaatacggttaccgttcacgataacccagccagcgtcaatattttcttcggctaatttacgcaatttcttttcgccaatgcggaagtatttggacgcttcttcaatcgtcagcgtatatttttcccagataggcacatcagtattgttcataatctatgcaccccctttactgtgtgtcattttttacaagcaggcagacggctttggaaagctccgttagtatctcaactattcccattcttgtgggcagaaccgcaccatgcggacgtatcattattctgtgaggataggtcgtggcaaaacgacttttccaacagtcgctctcggatcactgcgtgggtcgctcgctttcttttgaaaaggtcgtggcgtacagtccccgtggctcgctatctcacaaacgtatctgtctgctttattcagttgtcaaagagctgtggcgaaagcgtgttgctttcatgtaaaagcaggggcagagcaggaaagaggggattgaacaaatcatgctctgcggttactgcttgttattcttcggtttctaaaggaatatcaaagtccaaaatcattttgataagtgcttctctgatacgtccttttaattccatgtctacgactatgcagacattaccatatttgtcgtagaacggacgcaaacaacattttgatatgtacgggtcatacaacgccagtatcttttcaatcgcatttacgttgccgtccacagccgacgaaataaggtaaaatgacgggcgtgtgttattcatcattcatgttctcctttaattttttcttgatttcttcaagtgagttcttcctactgcggaacgacgttgaacggttaatctttaatctgtcgccgatttctgtatcgctcatgcctaagaagaaatacatcaacaagatttctctgtctttttcagacagatacttaatcgcttctgctaaatcatcatcaaggacacgaacctcaataccacatacatcaaaggcggtataatcgctttcgtattcgtcccagactgccagcttttctacgacgatttctggaagttcacaataggaaatttccttatttcttcgtcgctttaattctttgcgataattacggacaatgcctttcactacacgtttgagcttgcagtcaaattgacattgtattgtcttttggaagtccgacggtttcatatcatcacaccccctttccgttatgacgtgaaaagtgtttatccctctttccgcaccatatctgtacagcaaggtgtgatttgttgcatgattttgaaaaaaaatgaaaaaattttttcgggtacaaaaaaagcccgcacaaaacatatagtctgtacgagctattaaagctgtgagatattcagttgttaataaaatgctgttaggtagtgtatgaccgtataagattatgcttaaaactttccatgacacaagcccccttacagcacttgatttctattaaacttttgtcttttttgtaatcttgtaaatatattcttctggagtagggcgtttatttccaaaatactttctgaaattctcctgcacttctgggtcggtgctgttcatagcttcatcaatcgtcgcttcaatatcagctcgaacatcagctaatgacacaccgccagcttttgcaccagctttcaatgcttttttaatatctcgttttttaagtcctatcatagtattacctcgtcacaatttactgaatgttttagaaatgtttttcaaaatgcttatatagaataatccctaaaaatgtttgcagtaggaataaaccaaatataatgcctataatccatgcttcaatatgaagtaacgcaagtacaaaagcaacaaacaagtacacgaaagtcattaactgatatactaaagaaccagctttcattcttaaaaatatttttctttcatcaacattattgatgtgattttctctatttatattttgtaatttttctttattttttggcatttcataataacaaattttcaataattgaacaccagaagcaaaagctaaaccgaaccccattgcgtaaaaaagtgtagcgtaataatcagtatcaataacgaaatatccaaaacatataaagattatacctataataatctcaatgataaatgataattttttcttcattgttaattccacctttcaaaagactacattttctgtattaaaaaaatcgttttatggttgttcaaattatcctgaatgtaagtttactttagctgaacattttagaaagaaaaaactaaccaaaacgaatgtaaaagaattactggagggaaaagaaaccctggtaaaaggaatcaaaaacaaagagaaaaagccctacaatgccgttgtaaaaattggggaaaagggatatattgattttatatctttctcaaaataaacataaaagccctttaaagagggcttttatatattaatcacaaatcacttatcacaaatcacttatcacaaatcacaagtgatttgtgattgttgatgataaaataagaataagaagaaatagaaagaagtgagtgattgtgggaaatttaggcgcacaaaaagaaaaacgaaatgatacaccaatcagtgcaaaaaaagatataatgggagataagacggttcgtgttcgtgctgacttgcaccatatcataaaaatcgaaacagcaaagaatggcggaaacgtaaaagaagttatggaaataagacttagaagcaaacttaagagtgtgttgatattgcagtatcttaaaattttgtgtataataggaattgaagttaaattagatgctaaaaatttgtaattaagaaggagggattcgtcatgttggtattccaaatgcgtaatgtagataaaacatctactgttttgaaacagactaaaaacagtgattacacagataaataaatacgttagattaattcctaccagtgactaatcttatgactttttaaacagataactaaaattacaaacaaatcgtttaacttctgtatttatttacagatgtaatcacttcaggagtgattacatgaacaaaaatataaaatattctcaaaactttttaacgagcgaaaaagtactcaaccaaataataaaacaattgaatttaaaagaaaccgataccgtttacgaaattggaacaggtaaagggcatttaacgacgaaactggctaaaataagtaaacaggtaacgtctattgaattagacagtcatctattcaacttatcgtcagaaaaattaaaactgaacattcgtgtcactttaattcaccaagatattctacagtttcaattccctaacaaacagaggtataaaattgttgggagtattccttaccatttaagcacacaaattattaaaaaagtggtttttgaaagccatgcgtctgacatctatctgattgttgaagaaggattctacaagcgtaccttggatattcaccgaacactagggttgctcttgcacactcaagtctcgattcagcaattgcttaagctgccagcggaatgctttcatcctaaaccaaaagtaaacagtgtcttaataaaacttacccgccataccacagatgttccagataaatattggaagctatatacgtactttgtttcaaaatgggtcaatcgagaatatcgtcaactgtttactaaaaatcagtttcatcaagcaatgaaacacgccaaagtaaacaatttaagtaccgttacttatgagcaagtattgtctatttttaatagttatctattatttaacgggaggaaataattctatgagtcgcttttttaaatttggaaagttacacgttactaaagggaatggagataaattattagatatactactgacagcttccaagaagctaaagaggtccctagcgcctacggggaatttgtatcgataaggggtacaaattcccactaagcgctcgggaccccttgtaggaaaatgtcctaagtgtggcaacaatattgtattaaaaaaatcgttttatggttgttcaaattatcctgaatgtaagtttactttagctgaacattttagaaagaaaaaactaaccaaaacgaatgtaaaagaattactggagggaaaagaaaccctggtaaaaggaatcaaaaacaaagagaaaaagccctacaatgccgttgtaaaaattggggaaaagggatatattgattttatctctttttcaaaataaacataaaagccctttaaagagggcttttatatattaatcacaaatcacttatcacaaatcacttgtgatttgtgattcttaatgatacaatattactatacaaaaaaagaatggggcgtagttatggagaaggaaaaactaaaaatacttgaagaattaagacgtatttttatctaaataacgagctgttataacccatgtaatttgtccgatagcaataactcctgctatcgaaaaaaacacaactttactcatatatcccataaagacaagagcaaataatacaagaaccaataatgtaagtgttactttataagcattcgcaagagaagcattagtaattgcgatatttctttcatcattttctaatatttgcatttcttttgttggcttactgaatatatcacaacccataaaaatcaatattattccaataagcgttgtaccatagacaaccaaatctggacgaggtacgggcaatagttggtgtacgcctaaaccataagttagtaaaccacctaaaaagattattacaccgataaataattcaactttttgtatcttatgtttcatttgctttcctcctcataaataaatatttcttcaatactcatttgaaagtaccttgcaattttaaaagctaagataatagagggattgtagcgtccattttctaaagagcctattgtttgacgagatacttcaagagcagtcgctaaatcttcttgtttaatacctctttgttttcgtaattcttctaaacgatttttcacaacatacccctttcttgaacaaatggaaagtttgctttccttttctaatcttatgatactcctgcaagtaaagaatgtcaagcaaactttccatattttattatcctacaatcttccagttgctatccttatgtagcacaagttcatactgcgatatttgtgtagcctttgtctgattatcaaggaatttcacagcaactttgactttcacattgtccccgtcctttgtaaagatagggtttaccagttcagcataaatgtagtccctgccgataggctcaagcacatttcccgatacatagtaggcaagctctttttctgtggctgtcgggtacagcttaaagaatgtttcaagaaatgcagtagcgtcattgacggtatcagcgtctacacttgcatttgcttctggtgtcttaggctcataatctgatttctcgattgctggtgcaagggtagggttctgaacgattaccatatccccgtcagcgtctacatggacttttacggtataggttgctttcacattgcttgtctgttctccctcttttatctgctgatccacttcgtaggtagcagaaaaagtgtccgttcccgactgttcaatactccatacaatcacatctgtaactgtggagctggtcggtatatcggttctaatggtatccacattcaagtcctgcaattcctttgtcagataaccgctgattgcctgcgtccttgcttcaatcgcttctttgctgttactccatgtgtagtagggctttgcaaagttcttcacaaaattttctatcccgttggtgtcctgcaagcgaagctctatgatttctttttcatgggtcgtgtgctggtcgatagccgtaaaattcttatacgccccaaagctcacgcttgcgataagcaccacccacaatgcaatcacggattttttatgtgtgcctaccttgaaagtacgcacctttttttctttgggttctttgatagtttctgtctgtttcttattctttctaaacatgatgaaatcctcactttctattgttttactcgtcctgcaccgattaagtgctgttgccagtaactactacttaggtctgcatatcctatcgggtcgcctgcgtggtacatctgtgtcggcgaaacaagaataccgacgtgtgttacataacttccagcgttataggtagaatggaaaaataccaagtccccagcctttgcctgcgaaagtggaagatgttgggttgcgtcatactgtgcttgtgcggttctcggtaaggagataccagcttttccatagcaccattgcgtcagtcccgaacagtcaaaagaagtgttgggattgctaccgccatacacatatttccagccttgatattttaacgcttcattcatgaccttttgtgccagctctcccgatacctgcggaacagttaaatactgattgactaattcgacgtaaaattgattgccatactgataccgccaacccccgttcttcgcaacggctatcgggttggtgtaggttactttctttccacccgatttctcacgggcgaagctctctgcaaggttaaaggtgtgtttctttccttttcctgccacatatcccacataaccaccgccatagttataggactgtatcgctacattcaaatcgtcgataccttgatttttacaggaagaaagcagggacgcaaaatacttacacccctgcttgattgagctttccgtatctaaagagttgggcggtaaaccaagactttctgaactctgcataacatcttctgccgtaccgccactttctacttgaatgatagccagtagcacgttgacatactcggagataccgttttctctggcgtatttttccaccataggctgatgtttcaagacttctgcggataaattcatacccgtaatgccagaagaaaagttgctgttctcgtcgtcgctgtccgcactaatgaggacaccaaagaaaaggactatggaaaagaggataggaaacagactgccaataagagcgatatgtttcagtttcattttttcttctgtcctttcttcgttacaaggttacggttcttttcggtatgttccgttgtacgctttgattgttcaaaggtctgtttctttgtagtacgctctgctttgtaattctggcgtgtttcctgcgatactactttttctacattctgcctatgtactggctgtgcaggctgggtcgctttcttatcagaagcaccagaagataacggacgctctttcacaacatttgtcttgactggttcacttgcttttgaagtggtcgctgtggcaggacgtttcacttcctgcattttttccgcactcggctttggaatggttgaagctgtggctggtcgctcatggggacgggtagctcccgttgtcgctgatccgtccgtctttctttgtcttgcttcttgtgccttttgaagctccatacgtttgtcagcgatattctgtctatgctgttcctgcttttccaagcgtcccgtctgtctggactgctgttcctgcaccatgccacgcttgaagtctgatacgctggactttgccttttcctttgcggaatacaccgcataagcggtctgtgtcggcatatccttgatattctctttgacagcgttagccttgtctttcactttatttttcgtatctaagacagcacccacctttgagcctgcacgctgtcccatgctggaagtggtattgccccgattttctttagaagccgtattttttctttcggctctcttgccagcaacggcacttccagctaccgcaccagccacaccacccgaaataccgccagcacttaccgcccttgcaatacggtgttccatacgcctagccctatgtcgcataaacagatacggtctgcggaaaattcttcgtcccatgttttgactgtcgccagcattaagtgagaacatactcattaagtcgcccagtttcatatagataccagcaaaacacactatctgcaagaacgccaccataaagaacgggtagtctgtggagatgttataaaacatactggaaatgctgaacgccaccgttacaatgagcgttattcctgcccgtgtcattatggtattaaataccctcacgattgcctgctttgccatgctttcatagctcggtatcatggaaagtagaaagctgataggtaaaaacattgcaaagataataaagagtatctggctgaacaacatcatacccgtaagcaagaatacaaatatcgtgatacctaagttaaagaatagcaggaagaacaccatacctaaacggtttacgacctgcggtatcgtcagattgttgttgtcattgtcctcgatttctgttttcacgacttcctctctggtcttgccgtcctcgtcctctggacttactgataccagagcttctacacggtctgtcccgatttcctctgcgttgctgttaccaaattgaagcaagagccacggctgttccacttgaatggaaaacaagctgtcccgtatcaagtccacgctgtccttgccctcgctgtcagagttggggagcatgatttttgttcccaagtccaaagaagcggtactgatgtctgatgaaaattcatttatcttcttgatgtaatcgggagcgtaggcaataaaggaagcggacaacacgaacaccaccacaaagttaataacagcgtgaagtgccttgctggtttcgcgtttgataagtcccgtataggcaacataaagtcccactattaagataatgagaagcaggaaaccgacatagaagcccgtagaagaaaagccgttctcggtaacgcctgcaagggtctgtatgctttgtccgatactgtctgccatatcgttaataaaatcaagtttgtatgcttcctgcaccacatagcccgtagcattgcttaaataaaggcttatcgtccagacaaaattggtaatgcagtaaagtccgtactgcaccgattttccgataccgtccagccagttccatggcaaccacgaccagctattatccacataaaaatcaagctggtaattcgacagcggatattttgagtaaagattttctgcgtttatggtatcgtccacaagccccgtcgcatgagccaccgtccccagaagtgagagcaggataagggagagtgccacgacaaacagagccattttgagaaagtgaagtatcttcctttttgtgaacgcaccttttatcctttctttcatcactccacctcatttctctgtacgggcggtctggtatcaaaggcgtgtagcagttcttcaaagactgggtgtatctgcaccacaccgacacgcccgtataagtcctgcaataagcattgtccgttctccaaatcacgcaagcgtttctggttgttctcgtcgtccttgtcgataccgaaaaattctaaggtctgctttatctcgttgatgtcagtagaacgaaaggcaaacttcaagccgatattgtttttcagactttcctttgacacgtcgccagaagattgtgtaacaaaatagacgcctgcctgcatagctcgtccagcacgcaccagcttatttgataaagtttcgccttgtgccacatttaagaacgcccacgcttcgtcaaggtctacaatcttaaaaatgcttctgtctgaatggataaaatcaagggcaaaggtactaatcacaatcagcatagacaccgacaataattcaatggtcgtgtattcctcaaatgttgtatccttatctggtaatactaagtccgctacttgaatgatattgagttggttatccagactgattgcattttccaccgtaccgtctgaaaacagcaggtgtgcaaagtcgtagtccgtgaagctgtcgatatgttctgcgatatttcttgatatgggtgtatcttcacggcgtagctcgtctatcacatggagcaagccccgactgtcgctctgggtaacggagcgtaccgccttacgaagtacagggaatttttcgccgtccctagaggaaatacccgtaaggaatgttaagatgtcgattgccagactttcagcgtcttttacattcttcataatcacgaacgggtcaagaagtcctgcattgtccttgtcgctggtaaggtttacgatattgatttcatgggcgatttctgggagcgtttctttccagttgcccctctcagctttggggtctaaaatgactgcttgaccgccaaacagcaccgcataatataccagaagattgttgcagaatgactttccaccgccaagcgaaccgacaaaagcagaagcaagagcgtttgttactgtaccttttacaccctgcgaagctaacgacggttgcaggtacacatttcttcccgtatcaacggaatagcccatatagatacccgtagtttcccctaactgctgggtcgcaccaaaaccaagacctgccaagaaatctgattttacatactgcacgtagtcattgatatatcgcttgctggcaggaagaaattcagaatgaagccccagcatatccccagcaggacgcaccagctttacattgaggtcgtcgtaaaaatctttgacttcatcacaacggcgttttaattcgtccaaatcatcagccgatacacgcactacataagagagcttatacatactttcttttgtctggtctaagtccgtttccagctcatccacgctgtctaatgcgtccaccacatttgagcttgtttcacttcctgcttgataagcgtgattgtcaaggtctttcaattcctttttcttgttgcggacggttgttaatgctttacggttctccacgatttctacattcatagaagtatcaacggggaatgtgaattgctgttgctggaaatagaagatttcagacgacggaaaatcaagctcgccaacaatcgcattgacggtaaagtaggacacatagctttccctgtcctcatgttccaatcgcaaataccgctggctttcctcaatcacacaccttgtcggacggataaggtcgtagtattttatcagcgtttctttctgtaatttcttctttggtagctggtactcataatcttcataggcgataccgtccctgccgtaaagatgttccatgagatacccaaaatcatggatttccaagcgacgcaccttaaagcgacgggagattttattttccagcaacttttccattttcatataacggttgatttcatcattcggcatggaaacaaagtcattcatcagcgtgtggttcacttcatggagaaattccttgaatgtcagccacgccgattttttgatgttcttcagattgagctgttcttccgtaaccatgagcttaaagccaagaaaaaagcggtagtccacttgattgtccccaatcattgatactaacgcttcggtctgttcgtctatcttctggcaggcaacttcctttaatttccccgtaaccagcttctttgactgctcctgcatacttcgtattgagctttccgttgcaatctgcaacgcatgaatttttccctcacgggactgtgcgataagctgtcggaaactgtcatgcacgataaatttctgctctgcggataggaaagaatagttgtatggtatcagctcataataagcaaacacctcattgtccttattccagacaaggttattgtcaatatattttatcgggaacatagttcacactccttactgccgtgattgtttcattgagtatctgcttatgcagttttacggcttttcctgcataagtgattttcggtcgcagggcataggttatctgtgatttcaaaaagctgtacggcttctttccgtcaaaggttttctgcgacataaaccatgtgagagcaacgggaataccaaagtatttgagaaatgctccctcaatcatggaaagtgggggaatatccccaaacagaataatgagaaattccgtaatcacaaaccatgtaatctgtgtaaaggtaacgggaaagggtaagttaaagtcattgattgcatacaagactttttccacgttccagatacccgtataagatttaatctttttcaagttctttcagctcctttcgtaagtttctaaatagaaaaggacagccattttcagactgtcccttaaagagaaatacgctgtcagtaacaacaatgcttgtcgctgatcttccagcgttaatatggtatctcgcacatacctcggcttgtttcaataaagcaaccgcccatatccaaatctcgcccgtaggcttcatagtcaatgtaattctgtaagctgggtggaatgtccccaagtgcctgcaattcgtctatgtagtaataggcaacgtctgtcatagtttcacagtcgggataataataaatatcgtccttgtgttccacgacttcttccagcgtcccgtagtggctgataaattcgtccagacactctacaatatagtcgggaagttcctctatcatttcatacatctcattgagttcttcaatggaaacatactcgccaatcgcaatggggaagttgtcggtatcatggatagcgtattcctcatactgttcattcaagccgattttttctttcacatcttcctcgtcaatggggaacgtgaaccaagcaccgactaaatagccctcattgtatttgccaagattagcaatgtaaaccgccatatcatcaatcataagcaccacctcatttcctactctggcagttcaaagataccgtgttctgttactaaaaatttcccgtgttcctgcaagtgagaagcgtaggcttcaaagtcaaagtaatattcttgacagtcctcggataaatgcttaaatgtcgggtcgttcatcagcttttgccttgcaacatctatcatgcttttgcagtcgggataaaccgtaatcacgttcctgcaaatataaagtgcttctaaattttcatacacggtaagaagtgatacatattcttcctgcatatcgcttgaaagctggcggtacataaaatctaattcgttgagctggtacacgcttgtatgttcgtggacttcatcagcaaagggcagtaccttttcgataatgcggtaatccccactttctgcaccgacacctaacttttcttcaaactctgcaacatctatcggcaggtcaaaccagtatgatgttgtttcttcgccagttgttcctttcgtttccaccagcacccttgtttcctgcattgttcctcacgtcctttctgttgtttcatcacatcttgtaaggtctggtacgacataccaaacacatatttagaaaaatcttctaactgtctttcttcataatcggcagggttcagtcgtttcatttcctgccacaccttacgcttgtaagagggcaggtcggaaatataatcacagccgactttcgtctgcatatccttaaaaatatcgctcatttcatcactccaatctaaaatttaggtaagaaaaaagcagtcaatcctaagactaactgctttgtgtgtatggatatgaaattgtcaaactgggatttatcaatataaactaccatggaaaaatataataaaataccaaagtacttaatacaattccgacaatatacatttttctatagtttacttttttgaaaaatattatggtaaacacaacagctcctataatatccattaacaactgaaataggaatgtttgatgttccaaaaaataaataaaaactgctattgtttcagcaaataatgctcctactggtaaagaatataatactgaactaaaaatatgttccctattccaatagtacagaataaatgctgctattgcacaagcgattgaccaaacagtaaacaatatgaatagcccaaagcggaatccgccggaaaacataggtataaacattcctaatattgcttgtaaagcataaaaacttaatgtcattccaaacatatacaagaacgaactaattcctgcacaaatatttgaggtgcttaacataacgatgatagtattggtaataatccaaaaaccaaacaatgtttgaggtgatgaaaaactccatagtgtatctgcgggaaaataatctaacagtctacatatacaccctactaatataccaattacaaatatcgctgtataagacttatatgtatttcttagttttatatttgacacaatagttttcctcctaagttcaaattcatatttgtcgttttcttcatatccatattatatcactcacatattagcactacaataaaattttatgcaccgataatcttgttgaacagctctaacagtacatctttcacaccgccggcattgaataccaagccgacagcaatcaaggcaactaccaagaagccaatgagctttgaaaactcacgcttgaaccctaagtagataccgataaccacaatcgccataagcactaagctctgtgcgtttgataaaaaccattgatataaattttgtccgaaattcatttaattgtcctcgctttcttttaattgttccatttcatagtcagcttctttgccgacattcaaaatacacatcaagactacgccgatacccattcccatagataccagcaggaagtcttttaataatacccacattttttatcactcctaactttctactaaatcttttgcaggggtcgtctgctgtttgattatcatttcatgcttttctgtgagctttgcctgctgttcgattgtttccatgtagtctgtaccgtttcccttatcaatctttttcagcatttttaaggtcggtgctacctgccgttgtacccaccgcaatgtgcggtctaaggtgtaaggctctggttttgtcgtcagcttcaagctctgtctgttatcgccgataaaccaagcccagcggtcattgagcttccagtcattttttcgcttgtcgggttcttcatcaacaaaccgcacatactgattgatgatagaaaaagcggtctgttctgcgtcataataggtcagtaaatctcgtaccgcataataggctcgttcattgcgaagccgtatttcaaaacggttgataatgtcggcttcttccagaggtgtccctaacttgacgtactgctcatagtccttttcatagatacagaaatacacatctgatttcagcgacccaagataaagggtacgccccatatattctctgtcgtcctctctgtgcttgataagctcgcccgactggtaaaacttatagcttctggactttccgatatattcccgtttcctgcatttttccgcaagctctggaatatccaaaatgcccgtatggtcgttgatagcaaggtcgatacgcttcatcacgccaccgtctataagtgcgtccataagaaagtcataccagcttctttgctgtgccagcaggtaactttcaaactgcctgcaaccacgcccctttaactctaaaaggacacctttttcttcgtcagccgacgtatagataaagatgtcccctaaagagtaatgctccgtataactgtaacgcccgtaattttcatggagcatatagttgatattcagttttaatatatctttgatgatgtgctgtatatccagcgtgggaaaacgaattttcacataatcaaacagcatggtaagcggtgcttctggattgaactttgccagttctttatgcagagtattcagaagttcctttgacggcttcatttttccgctttctatcttgttgagatattctcttgtgataccagacgccaccgccagcctgccttgtgagataccgtaagcaatccgtttttcccgtaattcttttatccattgttcttcattcagaaccatacccccaatctgtcaagtgtgaagttttttaaggcgacttcacagccgatttttgctaggaaaccatgcgataagccttatgtttcctgtgtttttcgtctattgtctatttgcaaacgtacccctctgttagatactgaggggttttatcagcggacgggacaagccccgtccgccaagaacggaacttgcggttgagaaccgcaaaacccgtccttgtcgtccgtgtctgtgtcctgctgtgaaccttgtatgccctcatagataaccgcaaaatctattctttcatctgaaagtgcttctttcatttcttcagacagtcctttaagaaatacattacattgcagacaagccttatctaaaactcgaaatcgaaaatagattatcctgctttcaacgcaatgtctactttccaatctcattctaaacttatgaggaatgttgattttttcacgaataacatcatcaatgattttatctatccttgaatgaaatcgcagatttggattgacagaataatctaaaaaacaatctaacatatatttcctgcaatccgttgtaaaaatatctgtattcaagcacaaacagaggtagtttttcactgtgggtgcgtgataaacatttaatgtgtccttattcaatcacatcttcctttccttgttgttctggcatgacttgtctttcttgtgcaagcctgccgattgtttgtaaaaaatcatgtcctttcgggactaaaggcgtgtaaaattcacttatcacgcttgttcccacatcacaatagccacgccctttgatacgcttctggaaaaactgctttttcacatctgaaccgaacagcataccgtaacctaattcgctgatacgcccaagtcccacacggaaattgaagttatctctgataccgtccgagaaatactttgcgtctggacgctggcaggcaacgataaggaaataacctgcttgtcgccctaacataacgattttctttaactggctaagtaagctcacgctttctttcgtccccagcatttcaaaaaacgccacatattcatcaaagataagaaagcagggtggcagtcccagataggcgtagttttcgcccgtcttatagttcgggtgtcgtttcatttcctcacttcgctgtaccatgccctcataaaaggcattgacgcaatcaatcatttcttctttggtgtgatacacatttcccataactgtccctaagtccgcaaggtcagcgttcttcgggtctaagatgtaaaggacagcgtcggtatgcagtaaggcttcaatgagcgtcagcagaaaataggttttaccgccacccgttccaccagcgataagggcgtgagggagtgcgtcatattcccagacaagatttttcatcagtctaagacagccgttttctgcccgtacttcatcaatggtaatgcggttcgctatcatatcataaagcagggtatattcgatatagccgtcatgcagggtcttgtcggtcagctcacaatacaagccactttccaatttatcctctaaccgtaaaagctggtcttgatatttccccagcgtaatttcacagcggatatgaagcagtcccttttccatttgataataaatctttggaaaccagacgattttttcccttgatctgctttgcaggtcagtaaaaaaaccactgtcttgtacggtatcggcttcataccacttattctccagtatcattcttgccagcttttgacggtgcaggagcttcttgaaattgtcataacagaagcggtaatacagaaaagcgaccaatgcacaaacaccagtcgctatcagtatggttatgaagttgtaaggggagagggtcaagccgttttctaacaagctgaaatgctcccaatcggtacgcatgagctgtttcatattcagtagcaggagaaccgccacgaatacaaacagaagcgttcctatggaaaagtggtaaacaaggtgcttgtcgctggctctgatacggtgtcctttgttaaaaatcttttgcataaatcaatcactcctttctgggtatgaaaaaaagcagtcaatcctaagactaactgctttgtgtatatggatatgaagttttcaaactcgaatttactattccagcaactcaattcgtatcttttggctctggaataataatctcttttccctctttttccatccgttttataaagttatcaaaatggtctgtcataccatcaacaaaaaatgcttttttctttcttccattgacatacacattcataccaccgcgtttcattttacaataagatatgtctgatattttccaatatcttctaaaaataaacattttaataaccgtgatattatcttcttcaacttttatctcccacactccctttaaaggagcaatcataccaaaaagagtaactccaaaccaaataatagaaaatgggataatgaacatcaaatatcttttagaacaaaaattttcaggttcactccaaaatccccaaataaagacaacaagtacaaacaaagcacctattgcacatataaatgatacatctgatattgttcgaatagaaaatttatttaaagattttgttgttttatgatttcttttttgcattatatctaaaataaataaaacgatatatgcaactaaaattgtgcctaaatatttcatgtcttacctccaaaacttcatatttgtccgtttcttcatatccatattataacagttccatatatccactacaatgaaaatctatttagcaagcctattttttcggctgtccctgcgatgtatggttctgtggactgcctgcgttctggttgcctttattcttcaatacaatatcctctgcctttacataccagtccacatctgcacccgtataggtttttcgtgataccgtatcggctactggattgacaagttccacaactgcattgtacggaaattcctttaactgtacttctggcggtacagatacggggataattccaccatgcagactgcactttaaatcatatatacgctttttaagctgggtactcggtgtcccgtcctcattctgcaagaacacatcacgcaccgctgtaaattttaattctccaaatgttttttctttgtcaataacaaacccgtttgataatctcataaattcttcactcctttacttttcttcaactgctacaatatcatcagcaactaatacataatcggtatgtcccatattcccgattgcgtaacctctgccgtacaacttcggattgacaagttttactttctgttcatacttgaacttcttttcgccagcctgcacgggaatttctaccacaacattttcgcctttctgtacgtcggaataaaggttatagcttcgtctggctaagaccctgcggttatttttatctctttcaaagataggctcgctttcgcctgcaaattcaagagttccaaaagactgtgccatatctggcacgacatatttcatttccatattgttttacctcgtttctttctatttttgataagttaattgattgtgatttcttattctggcggtttgggaagtaccagcaatcccccagatagtaaagggtaaaatcaatgcttacgcacccttgactatccgtgttcttgcaggttgttggcagacaagccagaataagcaaaagtctgccgtttgaccgcttcggcggagagcgtgatttttctttcctcataccgttaccgccttatgattttttcattttacggcgtttgtagaagaagatacctgccagtccagcaccagaggtcaaaagaagtgcaagcagtccgtaaaggtttgtgttatcgcccgttttgggactgtcgctcggtctgtttggcttttctggtgtcggtggtgtttcgggtttctctggttcgtctggaacttctggcttttccttaaaggtaatcgtctgtcccttatcctcaatgtccttatgttcagtaactttcttcggttcgtctggattgctcaagtcgtacaattcctcaaaagttacaagctgtttgccgtcaagagaagtagcgtcaaaggtaaaggcaacttccactttcatagtttcgctgtcagcagtaaaagtgtaatcactttccacacgttttccattgataagaagctctgcattttcttctttcaacatctgccagcccacaagtttgtactgtgtgccgacttccaagccctttaaggttacggtatcaatgattgtaacgtcttttccagcttcaagctctttgttgccgtccttgtcggtagcagtcgtatgaattttgatgatacgctctgtgattaaaacggtctgcccgtcgtcctcaatgtccttatgttccgcaacttttacgggttcgtctggattgctcaagtcgtataattcctcgaatgttaccagatttttaccgccaagctcggacgcattgaatgtataggaaatttctactttcatttcttcatcatcagcgacaaaagtataatcgttttctacacttttcccgtcaatgataagctctgtattttcttcttttaacatctgccagcctttgagctgatactttgtgccttttgtaagtccgtctaatttgacagtatcaacgattgttacctcttttcctgcaaggatagtcttttcgccgtctttgctagtcgctgtggtatggatagagatttctttttcgtattcatcagtcagcgttcctaaatcgaccacaaggttatttcttgataccacgatttcaaaaggtgggataagttcaaaacctttgttactgtcgcaacgcatttcttcaatgatgtaggtatcataaggcaacgcacccttgctgtcgtctggttcagaagttccaaaccacacaccgtcctcgctggtctttcctgcgtttgtattgtgcttatgtgaagcccagtcagcagaagtggagaattgcccgttatcatcagttaccactacatgattttcgcccgtcgtcttgcttgtgatcctaaagggaacatcagcaagacgcttgtgtgtgcctgcaccgatttttacaccctcaatatcgccacgcttaatctgattgtagatagaatgggcttcgtcggttaagtccacgatttttccattttctgtgattgcaaaatcaatcggcttcgcaccgtctgtcaaatatccgtctggtgcttcgctctcaacgatacggaagtttccataaggtaaaaggtcagcagaagtagaagcgataccctcaatatcggtacgaattgtctttaccacttcatttttcttatagagcttgccctcaaccaatactgcattatcatttaaggaaatgatgtcaaaggcagtatcttttaaagttgcacttccttgtggtttggtatcgcccgtttctaaatctcgtttctgaattttcacaccgccacggataaccttatcagatacggaaaactgattacttccagttaatacggcaaggtcgccgtcctcggtaatctgtgttacatataagcccttaatttgttcggacttatcgccagcctgcatatatgcaccctctaacaagtagccgtttggagcttttgtttcttctacggttagtgttcctaaaggaagaacggctttcccgtcctgcatatagaagttgtcgccagataccttgtatgcgtctgctaattttgtgatgtagtgggttgacccgtcgctgtctgtttcagcgattgtctttataacccatgtacgagtagcttcggcagggagagtgtctttgttatagaatcctgcataatacttccatgtaaattccgcacctgctagagaagcgttaccctgcggattttctttctgtgtttccatatctatcttgaaaagctcaatcaaagtgtctgttactttcggtgtatctgatactttcaaagtcgctgtttttccagcttcaacctttaaggaatatacagttttatctactttatatcctgctggtgcggataattccttgatataaactgtaccagcctttacctctacaacatctgtatttccgttttcatcagtcgtaagggtggcaagctgtttcgtgcagtccttatcagaaaagacaccgtatgttgcaccagcgattgagtaattcccgttgccgtctgtaatgctggtattactggaagtcttttgcagtttcgcatttccgacattcagtttcgcccagaattgccccaattcctgcccctcgccagagtagatataaccgccacattcatagcgtcctttattttctttggcaaaggctcttgcaccagagaaaacttcgtcctgcgttgcctttggaatttcatcataagaagctcgcacgttatcgcattgccagccaagatgtacgcttaatctctgccagacaacaagctgtcttaaaaggtaggcatgattgttgcttattccgctgtggctgtctgtgtactgtttcacatattcgatagataaggcaacgtcgcttatctggtcggcactcatacgggtgcttgcgtcagctctggtcttgtagccgttcctaaaatctgtgttaatgtcgatacagtaagcgtcctcgccctcaacggtcaaatgtccctcgttaaaggtagaaccaatcgaaccgtcattcattactttttcaacgataccgacacgctcttttgactccgtccagtattgcttgctttctgcatgaacgggtgtcgtcggtaaagcagtaacgacagttgcaagagctaagaagcccgtacacaatcgttttaacatctttttcataaatctaatgctcctttcattttgggtaataaaatagccgtccaataagaacggctggaaatagaaaaggaacgtcatgttaggcgttccatagtctataagttattcaattttttcttgtttcaatactgatgtgttgtaccatatctttgcatatctaggaaaacttgcgtatcaaggctcattcgttagtagtaaataagtagtaaattgatgtgtttgtttccttgaaaatgctgatagatactgtgttttagcggataatcagatttttattgtgtttttatgagaaaaaggagaattttattatgacaagtttaatcgctataggtgcaggtgttgcagttcttacaggtattggtgcaggtatcggtattggtatggccacttccaaggcagtggatgccatagcaagacagcccgaggcagacggcaagatcacaaaggccctgctgttaggatgtgcccttgccgaggcaaccgccatttacggctttgtaatcggccttttaatcattctgttcttaaaataatcgatagcaggaaggcgctttattatgttaaatctaaacatttggaatattgcctgtacggtcattaaccttctggtgctctacctgttcatgaagcacttccttgttgcgccggtgcggaagatactggatgagaggaagcagatgattgaacgtgacctggatgacgcgaaggataccaggacacaggcagaacagatgaagacagagtatgaagcttccatgagcaacgcggaccaggaagcctcaaggatcatagaggatgccagggcaagggcgggagaggaatataacaggatcctggaccaggcaaagaaggatgccgcaaagaagatggaagaggcagacaggaccattgcgctggagcgggagaaagccatgaacgaccttcaggccggtgttgcagggctggccatgacggctgccgccaaactcctcagtgagcaggccggaccggacagggacaggaacctatataactcatttttagcaggatcaggtgagagcaatgactgagaaggccaggacatatgccattgtattatatgaattgggaatccccggacagatggttgaggatgcggccggtatattcagagaaagccagcagcttatcaagaccttaacaagcccggtggttccggccaggagcaagcacgccatcataggaaagatattcagggaaccggaattctccggactcatggtgaacttcttaaaaaaggcttgcgatgcggggtgcatcgggcagatggaggatatcgctgatgcatggcggtcatattcccttgaaaaagagggcgttatggaggcagaacttcattatgtgaccatgccgggtgcggcccagattgcaggaatgaagcagttcctatgcaggatataccataaaaaggatatcagccttaaactggtgatgcagcctgaccttataggcggattcgtcttaaaggcaggggatatagaatatgattacagcctgaaggggcagctgtcaaagctgcgccaggctgtggtaagataggagtcttgatatgagcacaatcagttcccaggaaatcatctccatcataaaaagcgagattgaggatttcgataccaaggcagccacacagcaggagacaggttctgtcatctgggttggcgacggtatcgccattgtatacggcatggagcatgccatgtatggagagattgtaatatttgaaaacggtgtccggggaatggtccaggacatccgcaaagatgaaataggcgtcatcctttttggaaaggatactgagataagccagggcaccaaggtggtacgcacgaaaaaacgtgccggcgtgccggtcggcagtggatttttaggcagggtggtcaatgccctgggagaccccattgacggtcttggcccggtaaaagaggaagattaccggccggtggaggaagaagcccccggcatcgtggacaggaaatcagtgggcgttcccatggagacaggtatacttgccattgattccatgttccccattggacggggacagagggagttgattatcggtgaccgccagaccggcaagacctccattgccattgataccatattgaaccagaagggcaaggacgtggtctgcatctatgtggcaatcggacagaaggcttccacggttgcaaaactggtatccacccttaagaagagcggcgccatggattacaccatcgtgatgtcctccactgccagcgaggcagccccgctgcagtacatagcgccctattcagggactgccatggctgagtttttcatgcatcagggaaaggatgtactgattgtctatgatgacctttccaagcatgcggtggcttacagggcactgtcccttttgctggagcgctcacctggacgtgaggcgtatcccggagatgtattctatctccattcaaggcttttggagcggtccagcaggctgagtgatgcaaagggaggcggctctattacggcgctgcccatcattgagacccaggcaggggatgtatccgcatatatcccaaccaatgtgatttccattacggatggccagattttccttgaaagcgatctgttcttttccggaatgaggcccgctgtcaatgtaggtctttccgtatcgcgtgtgggcggcgctgcccagaccaaggccatgaagaaggcttcgggcagtatccgtattgacctggcgcagtaccgggagatggaggtattcacccagttcagttcggacctggatgagtcgaccaaggaacagctggcttacggcaagcgtctgatggaactgttaaagcagcctcttggaaggcctttaagccttcacgagcaggtcatcacgctctgcgcggcaacccacaaggtaatgcttgacgtggatgtggataagattaaggaattccagatggatatgctgggctggtttgacgtgaagcatcctgagattggccgggagattgaagggaataagaccctgacagatgatttggtacagagaatcgtggacgctgccaaccagtacaagacgtccatataaccgggaagagggagagaatatggcaaatgcaagagaaatcctgagccgtatgaaaagcgtccaggataccaggaagattaccaatgccatgtacctgatttcctccaccaagctaaagaaaagcaagaagctgctggaggagacagagccttacttctatacgctgcaggatttaatccgccgtatcctgcgccatatgccggatgtggagcatttttactttaatcccagaagcgagatcaagggagcggacaggacgaagggccttattgtcataacgggcgataaagggcttgcaggtgcttataaccacaatgtgttaaaaatggcccaggagtggatggaacagggcgacaaccaccgcctttatgtggtgggggagctaggacgccattattttgcttccaagcacataccggtggaggaacagttccactatacggtacagaatcccaccatgcacagggccaggctgatttcctccaccgtgctggaggattatgagcaaggccagctggatgaagtatggattctttatacccagatgattaacagcatgaagatggaggctgagattgtccagctgcttcctttgaagcgggaggatttcagcaacatcgtgattccggctgacatcatccaggaagagatacagatggtcccatcccccagcgcggtcatggataacgtggtaccaaactatgtgacaggatttatattcggcgcgctggtggagtccttctgcagcgagcagaatgccaggatgatggcaatgcagtcggccagcgacaatgccaatgccatcttaagcgacctgtccattgaatataaccgtgtacggcaggcggccattacccaggagataacggaagtaatcagcggtgccaaggcacagaaaaagaaacataattcgtagatgtagaaggaggcagccatgagcaagggaaaaatcatacaggtcatgggacctgttgttgacgtggcgtttgaagatgaacaccttccccatataaaagacgccctgattgttgacaaccagggaaagaagtgcgtcatggaggttgcacagcatgttggcggcaatgtggtccgctgcatcatgctggcatccagtgacggactgtgtaaggatatggaggtggagccaaccggggcaggcatcaaggtgccggtgggcaagaagaccctgggcaggctttttaatgtccttggcgataccattgacgggggacagagcctggaggatgaggagaagtgggtgattcacagggacccgccttcttttgaggaccagagtcctgtcgtggagatgctggagacaggaatcaaggtcattgacctgctggccccatatgccaagggcggcaagatcggcctgttcggcggcgccggtgtcggcaagaccgtcctgattcaggaactgattaccaacattgcaacggaacacggcggctattccatctttaccggagtgggtgagcgttcccgtgagggtaacgacctttggaccgagatgggggaatccggcgtactggagaaaacagccctggtattcgggcagatgaatgaaccgccgggcgcacgtatgcgcgtggctgagaccggacttaccatggcagagtatttcagggatgtggagcatcagaatgtgcttctgttcattgataatatcttccgtttcgtgcaggccggttccgaggtatccgcccttcttggacgtatgccttcagcggttggctaccagcccaccctggccaccgaggtaggtgagcttcaggagaggattgcatccaccaagaacggttccgttacctcggtacaggccgtatatgtgcctgcggatgacctgacggacccggcccctgcaactacctttgcccacctggatgcaaccacggtgctttccaggaagattgtggaacagggtatctatccggccgttgacccgctggaatccacctcacgtatcctggaagaggatgtggtaggcaaggagcattatgaggtggctaacaaagtacagcagatgctccagaagtacaaggaacttcaggatatcattgcaatccttggaatggaggagctgtcggaggatgataagctgacggtaaaccgtgccaggaagatccagcgtttcctgtcccagccgttccatgtggctgagaactttacaggcgtgcccggcaaatatgtacctgtaaaggaaaccatccgcggttttaaggccattatcgagggtgagatggattcttacccggaagccgcattcttcaatgtgggaaccattgacgaggtggtggaaaaggccgggaccatggaacacagtgagtcctgaggtttggctgatgcatagaaaggagcccggatatgtctacattttggctgaaaatagttgccagcgaccatattttctataatggaaactgtgagacgctggtggtccctgcccatgatggtgagatgggtatccttccccaccatgaggccatgatcctggccgtccaggaaggcggactgcgctttagggtgcctcaggaaacacagtggagggaagccattgtgggacgtgggatcgtacaggtggccaacaaccgtgtgaccatgcttgtggatacggcggagaggccggaagatattgacgcggtaagggccagggaagcccttgagcgggccgaggaacagatgcggcagaagcagagcctgcgggaattcaggatgacccaggcatccatggcaagggcgctgtcaaggcttaagggaagccatctcaaggaattgggataaaacggttgagttaaaaccattgagatataaccattggaaaatggattcatatggataagataatggctgcaggtaaaaacctacagccattttgagttctggattaaaaagttgcagaaatccatgacaatgggattttccttgccatgggcggagcacataaggatgatctggcgccggcaggtctggtccttgatgggaaggagcttgaccggggaatggggggatagcggaccccattcagcggacaggggaccccatgaatactggggccagaagccgattcccagtccggcggcaatgaggttgcgcaccgattccgtggtatcgctctcaaagattacttttggcacgaaatcagcttctgaaaagtagctgttgcatatctgccggatgggacgtgaacctgccaggcagatatatcccgcattctttgtgtcagccagacggatggaatccttatccccataaggggaatgggtcggaacggccaggtacagatcctcctccagcatgaccatatagtcggaatattcgtcatttttaaggtctgagcgtatggcggacacacacaggtcaaagtccgcattggtatcggattggtacagctggaagttcacatccggccgcagggtcctgtatgctatgatacggttggtaatcagggtggaagctgccaaaagcttcagatggatggtatggcttgactggtactggccggccataagttccccgggaatccggtcaagggcgcttatgattggaatcaggcgcttttgcagcagccgtcctgcatcgtttaattcaatactccggtttttcctctcaaacagcgggatccccagttcactttccagcctgtgtatggcctgggacagagcgggctgggcaatctgaaggtgctcggcagcctttgtcatgtgctggtattctgcggttgtaagaaaatagcgtaactgtaataattccattttttacctctgcttattcatttgttcatcaatcattatataacacattgcttttttttgcatggaaaatttgttccgggcctatttgagaaatattcccatctatataccttgaaaatccctggatttactgttaaaataaccatcataggttagcctgaactaaccgaatgaaaatgataacatcaaggaggcacccgatatgagcaaagagaccttgaatttactgctcaggatgaaccatgacagattagaaacacagattgcccttcagtgcgcgccgcttctgaccgggatgaagatatccaatcttctcactgtcagaagcagcaggactcaggaggtcatggggctgtttgaaagaactgcaatatcctgttacctgctgtatggctccggggataagacaacattcctgctgtattcaaggtccgcgctcatggaataccttgcagaagaggatatagaaaggctgatgggcggcttagggtatcatgtcttggggctggaacaaatcctggaatgtgtttcggaaaagtatacggcacacatgaatggaaatggaggcttcccacatgaaataggactgcttctggggtacccgcctgcagatgtgctgggattcatccggaacaatggcaggaattatctgtgcacaggttattggaaggtttattccaaccagtcagagtgcaggcgcatattcaggagatacaatcaggcgcgggagaggctcatacatatggtttcccgtggactggggataggggatattcttgagatccatggattacatcaatataaatcaatgacaatttaggaggacaggaacatgagtaagataatggtggtatactggtcgcagacaggcaacacacaagccatggccaatgaggtggccgaaggagtgaaggaagcggggaaagaaggggcagcggtggaggtttcatccataaccccggatgttttgaaggatgcgcctgtgtttgcactgggatgcccggccatgggagcggaagtccttgaggaggatgaaatggagccgttcatggctgaagtggaatcctttgccggaggaaagcagattggcctgtttggctcttatggatggggggacggacagtggatgcgcgactgggaggaacgtgtggccggtgcaggcgcggttgtcgtgggcggccagggtgtgattgcccaggaaaccccggatgaggacgcgctttcacagtgcagggagttaggacgtaaattagctggtcttatgccgtgataccggcatcaggatttgatacaaagagttgacaggtttttggggtcctccggcaggcagcatgaaatgcggtcttccggaggactttcccatgaggttttgtatgtgggaggggaagaatgattgcattttcagggataaaatgatatggtatagatagaaaatttgtgaatgaagcggccgttccggggaatacagagggcgggaatgaatttccggacactccctgccggggaagggccgcttttatccgcagcggcccgggaacccttggactgctggaaaaaggggaatgaaacgtgttggaagatataaatccataccctgtaaaagacagggaattgaggggcagggataccatcctgattgtagacgatatagaggtaaaccgtattatactgcaaagtatttttgaaaaggattataatctgctggaggcggaaaacggggatcaggccatggtactgcttaaacagtaccacaggaatattgctgccgtacttttagaccttgtgatgccgcagaaggacggctaccaagtcctggcggagatgaatgatatgcatcttttgccggaatgtcccgttatcatcatcacatccgaggattcgccggacaacacggtgaaggcatttgatttgggcgcatcggatattgtgatgaagccttttgatccggtcattgtgaagcgcagggtggagaacagcattgccctcagccggaaccagcagaaccttcaggagcggattgatgaacaggccgcccggttaatggaatccaatgcggtgatgattgacgcattatccgccatcatcgagtacaggagcgtggaaacagggcagcatatacagcgtatccgtatgtttaccaggatactgctggaggagatatcgggaaacttcccggagctgggcctggaccggcgtcagattgacattatttccagtgcctcttccatgcacgatatcggcaagattgccataccggatacaatcctcaataagcctgggcggctgacagaggaagaatttgagatcatgaaaggccacaccacaaagggctgtgagatgctggtgaatcttgaccgcatgggggacagggaatatctgcaatatgcctacaatatatgccgctatcaccatgaacgatgggatggcaggggatatcctgacgggcttcgcggggacaatatcccggtctgcgcccaggtggtgggtatcgctgattgttatgacgccctgacctccgaccgtgtctataagaaggccataccgcctgcgcaggccatcaacatgatattgaacggggagtgcggtacgttttcaccctggcttttggaatgttttaagaatgtaaaggtaatattttccaagctgtccgacgagtacagggatgggcagatacagaaacagcctgccatcaacagcgatatacggctttgcatggatggggatagggacagcaggcagatgggccagcagaagtatctgacactgcttaaatatgtggattccactgttgtggaggtggattttaacacaggcgtttatcatgtggtttatctctcaaaccatgactttgacggcctgaaatccggcggcagcttcaaggatgccttttatcattttgtggagacatccgtccatcctgaggacagggagatggcaagggcccttatgggtgcttacatgaaggatttcatgaaggaaggatttaataagagaagccgtaactatcgcatatataaccaggtggagcaggtttaccgctggtgccgggccaccatgctccgcatcaatacaggaaacccttatcagaaaagggcactgattatctgggaagaactggaggcagaggaggatgcggttccggccggcagcaccatgcagatgaggatgtttaatgatgctgtcttaagccatatggtgggatgtgtccaggcctgcctgaacgataaggagtttaccatcgtagagaccaatggcggtatgaggaaaatgctgggctacagcgacggtgagatcaagacccggtttgacaaccggtacctgaatatgatttacccggctgaccggagccggatcatggaagagacggggagacagctggagtctggtaattccgttgaactggaatacaggcttactgccaaggatggaaggattatctgggttttggagcgatgccagtccattaccggaaaaaacaacatggaatatctggtatttgcccttatggacatcactgcttctaaaaaagaccaggaagagctccgtctttccctggagcgccataaaatcatcatggagcaggcagaggatgccctgtttgagtgggatattgaaaaagatacagtcacccactctgccaattttgagaaaaagtttggatatacccccatttcaaacaatttcagcaaacgtatccggttcgtatcccatatccatccggctgacgtgcctgattttacggaaatgctggattcgctgatgaaggggacgatttacagggagattgaattcaggctgtccgatgcagcgggacggtaccgctggtgcaggctccgtgcctcttcccagtttgatgcggcaggcagggtcagcagggtaattgggatgctggctgatgtggatgaacagaagcgggcggaggaggccctccagtatcaggcggagcgggatgagctgacacagctctataaccgcaggacggcaagacggcttattgaagccatattggaggagccctgtgtccagggatacagggccctgatggtcctggacgttgatgactttaagaaaatcaatgacagcaacggccatatgttcggggacagtgtgcttaaggcagtggctgacatactgacccggcagttccgcagcgaggatgtccttgcaaggataggaggggatgagttccttcttttcatgtcccatgtcccggatgtaaaaaccgttgaaacacgcatggccatggtcctggattccattcaggacatgtgcctgaagcagggtatggtaatccaccccagctgcagtataggggctgctttccagcccattgacggcaatgactttaacacactgttccagcgtgcggatgctgccatgtatggggcaaagggtaaggggaaaagctgtttccagatgtacgatgcctccatccgcatgccgtcggacctgggtatcgaagcctgaaattttatgtgaaatatgcccatatgtccttttttatgaactgtccttttcctataatggttatataaaatcttatgggaaagagggcggtttatttatgtttacatgtgatatcctgattaagaatgcaagggtactgatgccggatatgtcggttgcggaaaaccggacaatcgcgattaaggattccaggattatagggattgcagaaggtgatggggattatgaggccgggaccgtgattgatgattccggccttctgtggatgccggggcttacggacgggcacctgcataccagccagcagtttttaaaggggagcctgctggatgagaagccggttatctggaaacgtatcaatgtgccgtttgaggcatccctgacagaggaaaccatggcgctgagcgcaaggctggcagcagcggagatgattaaaaatggaaccacctcctttgtggacgccggcggccctcacatagaggcggctgccgaggaatacataaaggcaggcatccggggggccctcacctggcagaccacggacggcgtgaaggtgccggataccctgcgtgttgaaacaaaggacgcagtaccaaggctggaacggttccaccgggaatacgacgggaaaggaggccttatcagcgtttattattcaatcacatccctgatggcctgtaccgaggagctgttccgtacggttttcctttccgcgaaggagaggcagataccggccgaatgccacatgaatgagtatgccagcgaggtcctggactttatggaacggtataaggagcggccttttgaataccttgaacacataggcgccctgtcggactcctttgttgcggcccactgtatcatgctatcagaatcagagattgagattgtgcgcagccataaaatccgtgcagtacactgtccgttcagcaactgcggaaagggtgttccacagacaccaaggcttcttgcagcaggaatcccggtggcctttggctccgacggggccggtcatgggggccttgacctgttccgggaaatgcgggcgttccgctgtgtcatgaatgtgacccatgggctttccactggaaatccccagatcatgcctgcaaagaccctgcttgccatggcaaccgcaggaggcgccggcgcccttatgcgtgaggaccttggaaccatccgggaaggcaatcttgccgacctgattgcagtgaatctggaccagccccatctgatggcaacgggcagcattatcaattcccttgtggagagcgcggccggagccgacgtaaagcattccatcattcatggtaagcttgtgatgaaggaccggcagctgttgaccattgacgaggagaaggtgctggctgaggcaaaggccgtcatgggaggccatgggttctttacaaagcagggcgcctactgcggctgatttaccgcgtccagcgctgcttgggctgtcctggcagcttcatccagggcatccctggcaggaatgttctctatctccaccttatcggcggcaatggccagggcatcaaagattttgccgcccgtggggtctaccgggtcaggggaagcgtgcatggcctgggatatggggaccagggcatggggattgtgttcagtgtaggattgatactcagggattcccagggtgctctttcggaccgggatgtagccggtggccatggaccacttcgcctgctgggatgcgtctgcgaaataccggatgaactggtaagcgccgtccactgtcttatccttgcccgtatcaatcatcaccagctgcagtaccctggccacaggcgctgatccatgcttgccgaagccgggctgttccatggcgcctaccttatggaaatccaggtcagcctggtcgccggaggaaccggtatagccgcccgccttatcctgaagcacatcgcccattgtatcataccagtattcccagccctgtccgccgtagtggacagtcatggtcttatcttcgtggatccatccgcggacagcttcccaggaatcaatccaggcatccgtgttgatgagcaccttttttccatcttcatctatcatggaaccgccgttacttaaggccatgtcaatcaggttatcttcaccccacatgggttcccatccataggctgttccgcccgtaatctccttaatgaccctggctgcgtcggccagactttcccaggtgtccagtttatccggctggatcccggctttttcaaaaaggtcccggttatagtacatgacctgggtggtgccgtaagcgggcatggcatacaggcccccgtcactgtccaggcactggctgtaaaaaacagggatgaagtcatcctggtgaaaggatgtatcctgctgcgtatatctgtccatgggaaccagcaggtccttctgcatgaggttgcgtgatttgtcagaatccagcagggcaatgtcagcggcatttttcccggcaatcccggcctgcagcttggtgtaggtctcgtcataatccgcctgctggattcccgtcacctcgtattcgtcctgggactggttaaaggcctggatgatgtcccccatcacgccggcggctgtcttgccgccggaataccagaatgtgatctgtacctttccgtcaaccgccgcatcccttgcccgacccggggcattgcagcccgtcatcatggcacagccagttgccaggaataccgtggtaaggattttcttcttaaatctgttactgaatctgaatgttctgatcattttatgttcctcctgttatgtctatatgaaattggctgtactggttactatgcaaagctgtggttactgtgcaaagctgtggtttctgtgcaaagctgtatcaggctcatcccttgcacccaaaatccgtgattccccggacaatcagacgccaggcagatatgaaaaccgccagcagggggagtacggcaacggtccctgccgccatcacaagggaccactgggttccgtatgcgcctccctcatagagaaatcgccttaatccctgggatatgaggcttaaatccggggaatccgtgataagggacggccacatgtagctgttataggtgttgatgaatgacaaaaggatgaaggtcataaaggatggccgcgtcatggggactatgatccttgtgaggatggagagatgtccggccccgtccatcctggccgcctcaatggtttccatggggactgcctcaaatgcctgatgaagcaggaaaatgccgaacacgctgactccattggataatataaggccctgatagctgtctaaaagccccatcctggataaaatgatatagcatggaatgtaggtgacggcagtgggcaccatataggtaaacaggaccagccggaaaagcatgttcctgccttttactttcatgaaggctactgcgtaggtgaaaagggcgcagcacacaagctgtatggcaatcactgcaagggatacaaaaaagctgtttgcaaggtatcgtggaaccggtgaatcagccaggatggaaaggtagttcccaaactgggggacagaaggcaggaaggaagccgtgtccatcacctcctccctggtcttgagtgaactgacagccatccagaggaaggggaatgccgtgacacagcaggtgaatcccaatacaacatggacagcggcgcgccggatgatccgtgcccatggaatgacaggcctggtcatgatttttcctcctttttcatcttaagctggatcagggcaaggctgatgccgataaccatgaggatgaccacggccgccgccccgcggcccatgtcaaactgttcaaatcccagctggtaatacagatagagcagcgtcctggtacttcctgcaggtcctccctgggtcaggatctgaatctggtcataggcgcgcagggaatccgcggtcatgatcatccctatcataaggatggcaggacgcaggattggaagcgtgatatgtacaaagcggttcaggcttcctgcgccgtcaaccgcggcagcttcgtaaagttccgtgggaatccttgataaggccccggcgaaaagaagcatcacataaccaaggtttttccacacggttacaagggcaatacttgccaatgccgttgaagaactgtgaagccagggaagtccggccatccccaattgacgcagcagggtattggccaatccgctatccggttcaaaaatccaggtccatacaatggacacggcaaccgctggtgtaatccagggagagaagaggatcagggagtagatggtatgcctcccggcggaataaacaagcatcgccagcagcaatccaaggcatgtgacagggattacggtttccagggcaaacaaaagcgtatggatgagcgcatcctggaaggatttgtccttaaacagcgagctgtaattgccaaatcctgtcatgtggaagtccgaagtcatgtaatcccagtcagtgaagctgattcctatggatgcaatgatgggaatcacccagaacagaacaaggaatatgagggccggagccgtaaacacggtaaatataagccttggctttaattgtttctggagataggatgggtgcatatatgattcctcctgaattttgtgttcaaaaatatataaaataataaaatattgaacatgtgaaatgatagcacttaatccatatattgtcaatatattgttcattttatttaaaaatagttaaaaaatgaaagagatagatgcaaataaccatcccatgacaggatggttgcattacaaaagataaattaaaagctgttcatatcctgttcaggtggataggacgtagaaggggttctgtatttatacccgtgtatttgctataatagggaagaaagggacattgcgcaccatttgacagataggaggacacaatgatatacttcacttcagacctgcatttttatcatgataatatcataaagcacaccaaccgcccataccggggttttgaggaaatggaccatatgaagagaataagggtattatatataaaagcgttgtccgcggttttaccggcggccgtgttttttcttacaggatgtcttcaaaaacctcagtacagggaagagacatatgtccttgagcaggaacatgccgtcactttcacggacggtggcacagcagatctgtggcgggcagtgcacagcccatattcctgttacaggcttacagatgggactgtccttctcacggtccacgacgttgccggaccggaccatgtttatgtgggcgggattgacggctttgatgacttgaaccggaccgcgcaggattctataagggcatactatgaagaacagggactgctgtatgatatccatagagaactggaggatgcttacagtgaatacaggatgtgcagggataatggaacaggctatgaggtgcggtacataagccaggacatctcacccacggcctccaatgacaccatcatatgtttcctcacaacggtatcccttcccatgaccggagcagccatgcaggaaatccggctgggcgctgtatttgacagggagacaggaagggcgctgagcaactgggaattatttaatctgccggaggcagaggccagacaatggctgttaaaggccgctgatatcaatgaccccggacttctttctgaaatggaagcagccatgaagcctgagcatatcattgtgtttccggataatctggaggtgggttttccgcaggggacattggagggtgaggaatacagttatctgattggtcttgattatgataaggagctgaaagccgtcctccagccctgggctgtccctgattccaggtaagatggcaaaataataggaaattctgggataatgactgtttctgaactgtatttccggacatgtttttgatataatagaagaaaatgtttttgaggatgtattacttctaaatattaacaagggagggacactgccatgtttttagttgttaagcgggacggagagaccgtggagttccagctggagaagatatcttcagccataaagaaggcatttaaggcaacagggaagtcctatacggatgacatcattgacctgctgtccataagggtaacctctgatttccagaggaagatgcgggatggccggatatcggtagaagacatccaggacagtgtggagaaggtattggaggaatcagggtacacggatgtggccaaggcatatatcctgtacaggaaacagcgcgagaaaatcaggaaccttgaaaagaccaccctggattacaaggacgtggtggataattatgtaaaggtagaggactggcgggtaaaggaaaattccaccatcacatattccgtgggcgggctgatacttaataattccggcgcagtgacagccaattactggctgacagagatatatgacaaagagattgcggatgcgcatctgaacggggatatccatatccacgatctgtccatgctgaccagctacagctgcggctggtccttaaaaaagcttctgatggacggtttaggcggcatcacagggaagattacggcctccccggcaaagcatctggcaaccctctgcaaccagatggtcaatttccttggaatcatgcagaatgaatgggcggcctcccagtcattttcctcctttgatacatatctggctccttttgtgaaggcggacagcctgtcatatgataaggttaaaaagtgcatggaggcatttgtgttcggtgtgaatacccccagcagatgggggacccaggcgccgttttcacacatttccatggattttaaggtgccaaaggacatggccggggaaaaggccattgttggtggaaagatgatggaatttacatatggggagtgccagaaggagatggacatggtgaaccgtgccttcctggaaaccatgctggaaggcgatgccaatggacaggggttccagtatccaatcccatcttacgggatggctgagggttttgactggtcggacacggaacagaaccgccttttattctcgctggcatcccgtcatggaaccccgtattttatcaactatgtaaggggaggggctgtacagggggaagaccgggttacctatggggatgaccgccaggatttacatgtgctgcacagaaaggccggcggcttctttggatatggcgagcacacaggcgccatcggcgttgtgacaatcaaccttccaaggattgcgtaccagtcaaaggatgagacggaattttataagaacctggattatatgatggatctgtccgcgcgttccctggatattaaacggagggtaatcagcaacctgttaaagggagggctttacccctataccgcctgctatctggatgatttttcccaccatttttcatccatcggtgtcatcggcatgaatgaggccggattaaatgcctcatggctgaaggcaggcatggaagcggaacagacaaggcaatttgcggtggctgtcctgaaccacatgcgtgaaaaactggtggaataccagctggagtatggtaccctttatggattggaggcaacaccggcggaatcagccactttccgttttgcaaggcttgacagggaacggttccctgaacttaagacagccggcagggaaggggatgcgccgtactatacgaacagtaccaagcttcctgcggattacagcatatcccttgatgatgcgctgggtaaccaggacgcggtgcagcctctttatactacagggactgttttccatgtgtatgtggaacaggaactggaggagtggagaagggcaagggatgtgctccacaagatcatcacggaacatgatatcccctgctgtaccttatccccggtctattccatctgtccttcctgcggctatctgcgcggaagccaggaggtgtgtccgaagtgtggggctgccgcggatatctacagccggattgccggatattacagaccggtgcatgactggaatgacggcaaggcccaggaatttaaaaacaggattatgttccatatctgaacatgcccggacagaagggggtaacatatatgatacagtcaggggaggctgcaagaaccgtgaaacggttttttgatgcgtatctgaaccagagggatattgggaatacgcttgagtgcctgaccgaggggatacactgggtgggaaccgggaagtcggagatggtgtatggccgcagccaggcagaagaggcgcttcaggcggaattttcccaagctccggaatcctgcaggattgaatatgagagcgttgaggaggcatatgggacggatgattgctccctggtacttctcactgccacggtatatccggggacgccatccggcacggccatgtggttcagggtgtctgctgcctgtgtcgaggatagggatggtatatgccgcattgcatccatccacgcatccacccctgacagccggcaggaggaaggcagtttctttccgtcatccggtctgagccggtccgagatggaggcccgtctgggagccaaagccctggatatcctgggaaagaatattccgggcggaatgatgggaggatatctggaaccggattttcctttatattatgtcaatgatttcatgctttcctatctgggatatacatatgaggaattcgtgaaggcaattgaagggaaagtgattaactgcatgcatccggatgaccggaaacaggtggatgacctggtgacaggggcctttgagaaaggcactgactacgaggtgcagtacaggatgaggaaaaaggacggcagttatatttgggtcaatgatgtggggaaaaagggatggtctgaggatggacaggaggtctgtatcagtgttatcagggatatttccgaggaagtggaatccaggatacgcctggaaaagcaggccagggaacaggaacagctggcagaccagtacaatcacctgctgcagtccgtgctctgcggcatcgtgcagtatcatccaaccagccagggtgtggtgttcaggaatgccaacagggaagcaatccgtatcttcggatatactgaggaagagttctgggccaggaagtactggcggatggataacctggttgcagaagaggaccgggattatattggggatgtgtttgcaaagcttagtaaaccgggagataaggccagctatgaataccggttgcgccggcaggacggcagtccatgctggatcatcggcagcgccgaggtactgtcagacagcagcaaccaggcatacatccaaagtgtgtatctggacattaatgagagcaaaaaggcagagcagcgcaatcagcgtctcacagaccagctggaggccagcgataaggtgcttcatatggcattggagcatactacaaccagtgaattttattactatccggataccagggaatgtatggtgccggccaggaccagtgaactgtattgctgccaggaacattacgacaacctgccctacagctttgccatggaacgggtggatgaaccgttccggcctgctttttatgagatgtatgagcgcatccatcatggtgagcgcaccgcaagctgtgaattcagggggcgcaaccaggcgttctggtgcaggcagaccttgtctgtcatcctgcgcaatgatgatggctcccccaggcttgtcattggcatcgtggaaaacatcacacggcagaaaacagcggaggaggcgcttgtaaaggcaaggacacgggacagccttacgggcctttataacagggaaagcggtatccgtctggtgcaggaatgcatggcggacaggggaccgggggaacatggggtcctgatgcttctggacatggatggatttgaggacgtgaaccagaaggagggcaggatttttggggatgtggtactccaggaagtcgctgatatcctccggacggaagctggcaaggacagtatcccggtccggcttggcggggacgaattcatgctttatgtgaaaaacagcaacaaggcacaggcaacggtcataggtcccaggattgcaggccaggtacagaatgtttttgtgaatatggaaaaggatatacatgtctcagtcagcatcgggatgtgcagcaccgaggtgacagaggaatataatgccctttaccgctgtgcggagagcacgctcaaatacgttaaggagaatggaaaaggccgggcggcctgttatctggacacttccaatgaactgggagtgttcctgacacagctctatacggaagagcatcctctcaatgcaatcgagatggagacatcacatctggatgacgacctggtatcctttgcgctggaccttctcggcaagtccaaaaacctggatgacgctgtgttcctgctgctttccagaatcggcaagaagtactgcctggaccgggtatccattattgaagccagccaggcctatctgtcctaccgcttttcctatcagtgggcgcgcaaccgggcggaccttcagctgggacaggatttctatgcctccaaggaggattttgatatctgctccaatatgtatgatgaggatggcctggctgaccataatgtccgggacggaatctcacggattgcatcatgcctccatgcaggtatctggaactatggggagtatgtgggttccatgagctttgaggtggatgagccggattatcagtggtcacaggaacagcgcaaactcttaaaggaactggtcaggattgtcccatcctttgtcatgaaatccaaagcagatgcggtcagcaaggccaagacggatttcctttcccgtatgagccacgagataaggacacccatgaacgccatcagcggcatgaccaccattgccaaaaatgtcctggatgacagggagaaaacactggactgcctggagaagattgaatcagccaacacctatctgctgaatctgattaatgacatactggatatgtcccgcattgagagcggtaaaatggaactgagcaccagccccatggaccttaggcagcagatagacgggctggaagccctgttccgtacacaggcagaggaaaagcacctggatatgaggtttgagaacagatacagcagtaccaggctgctcattgcagatggactgcggctgaaccaggtgctgatcaacattattgggaatgcggttaaattcacggagcagggcggcatcacggtaaaagtggagcagctggaggagtcgcccagggcagtccttaggttttccgttgccgatactggaatcggaatagaaccgtcagccctggaccgtatctttaacgccttcgaacaggcggaggcaggaacagcggccagctatgggggaaccggccttggactgtccattgccagccgcctggtgcagatgatgggcggtaccctggaagtgagcagccagataggaaaaggctctgaatttttctttacactgggctttgattatgcccaggaagccatatccgatataccgcaggacgaagccgtccccctgcctgatttccatggacgccgtatcctgctggcagaggacaacgaaatcaaccgggagattgcacagagcatccttgaaatgaacggattttccgtaacctgcgccgttgacggacgcgaggccctagattgcttctgcggcagtgggccaggggaatttgatgccatactgatggatatccgcatgcctgtcatggatggcctggaggctgccagacagatacgtacttcgggaaagccggattccaggaccattcccataatagcccttactgccaatgcatttgatgaggatacgaagaaatccattgaaagcggtatggacgggcacctgtcaaagccaatccaggtaggacttatgatggaacttttggggaaatgcattgcgaatcatacggaaaagaaaaaacattaagatgcatagggttaaaggatacggatacgattaaggaaatgattggaaatatggaataaagcgggaaaggaaaatatggcttggacttgaaatcatgcatactttctgacaggatacaaaaactatcaccagacaggaggtatcattatggcaaaagcaggtatgagacggccaagtccctatgacccggataaccatgggacagaaaaccatcacaagatgaatcatccgaaaaatgaacaggcacaggtgccggagattcagggcgcggcaaaaaacgggaatgccaaggcaggccccatcaatgcccccaactgggcaagggatgattataagacaggcgataagtataattaaggttttcattctatgcaatgaaaaaaacagacagccccatgacactggtattgattctgataacgggttatggggtgattcttataatatgaccataggtggggaaaaccttccagctggaatatttgaagagggtccatgcgattatatgggcagacgtgatggaccggagcggccggaataggggcggtaaacataaattattgtttaaattccggctgtcgaattgcaaaagtcaggtaattatggtaatatatagttaaaattcagaagaaggaaggtactggttatggataaggaagtattaagttttgttgtagaaaagactaacgagttaataaacgcagcatcctgcaacagcgagacaaaggcagccgcagagtcatggctggcagcggtgggaactgacggcgaggcggaagcaaccaaaacatatgtgaaggaactggaagcagacatcatgccgattgatggtttaatcggatttgcggagtcggatgccggagcacaggtatttggagcggaccacgccagggttgtggctgcccatgccaaggaaatcaaggctgcaggggcgaaatattgtgattgcccggcctgcgcggcagtagaggcaatccttaataaaaaggaaagcatcctcggatagaagcagctgaataacaggaacattacatagggcatcagtcatattaatgattggtgccttttctttaccgcataatccggtaggtgggttaaagacatgggcgcaggaataggattcataatattgatatttcagccatgttttgctatactaagtgctatatatgcatatgaacaaggacgtacatgggcgacagccggtttgaagcacaagtatatacaaagcatcatttctttgcgaaagagttggaataagatgaataagacacatatatttgagattatgaatgggaattttatagcaggggctaatccgagattagagcgccatgtgcgaaatgaatttactgagagttctgactgcctggaggcgtataacaaaatatacgaagcgcgggtacgtatggggaaacggctggggaccggagaggaagacccggatataatggatattgttgatggtgctgaatcaaagatacagtatatctgtttaaagatgtatgattacggtgccggactcctggccatgaccggtggcggtcaagagttacaactgatacagataattgagaaagagtggatggacgcggaccttcatgcaggaaaaaacattggacatgccatggcccggcttgaggagcggatgggtacagacagcacggatccggatatacggatcctggttgaaggctatgaatacatagcccgccgcatgggagtgaagatgtatggatatggcgcatattttacaggccgtgtcaatacagccccggatgtcccggactattatgaaaatgcagaaattgttgataaagacagatttaattgacgattaatttccgaagatatggtaaaatcaacatagcaggacacaattgctttaaaaaacgatttggaggggaaggacatgtcaaaaagttcagggattttacgtatctgcgaagaaaagggaatcaagatgattgatttcaagatgacggatttaagcggccgctggaggcacatcaccattccggttgaaaggtttgatgatgggatttttacacagggcattggttttgacggctccaattatgggtatgccccagtggaaaaaagtgatatggtattcatacccaatccggaaactgctgtggtggatccgtttacagagattcccacactgaccatgtgcggggatgtctgtgtcattggaaaggaaaacaagccctttgaccagtatcccaggaatgtaagcttaagagccattgaatacatgaaggaacaggggattgcggaccagatgctcattgggccggaatttgaattccatctgtttgacaatgtgagctttatggtggaaccgcagcgcatggcattctcagtggataccaggcaggctgcctggaacagcggacgtgagagcgctgacaacaaaggtttccaggtccctggcggagggggataccacattgccgcccctcaggatgtggcgtataatttaagaagcaggatgtgcatgatgcttcaggactggggtgtggatgtgaagtaccatcaccacgaagtgggcggttcgggtcagatggagatagaggtggaactgggcgacatggtggacatggctgataagaccatgattgtcaaatacgttgtccataatgctgcggtccaggatggaaggacatgtaccttcatgcccaagcccatttacaaagaggccggcaatggaatgcatgtccatatgcttctgatgaaggatggggagccggttttctatgacgaggatggttattccggactgagtaaaacagcccactattttataggcggcctgttaaagcacgtggcgtccctgtgtgcatttaccaacccgtccaccaattccttcaagcgccttgtgcctggatatgaagcgccggtaaccatcggatatgccacatccaaccggagcgccgtcatccggattccggcctatgcaaagacgccgaaggcaaaacgcttcgaactgaggaaccctgatgcaacagccaatccatactatgcttatgcggcaatcctcatggccggccttgacgggattaagaacaggattgaccctgcagaacatgggtggggaccttttgactgtaatctctatgaacttccggatgaggagaaggcaaagatccagtccctgccaaaaagcctggatgaggccctggatgccctggaggcagaccatggttatctgaccgcgggcggggtgttcccggaacggctgattgaagtatggcttaaaaagaaacgggaagagagccgcgagatgtcacagattccccatccggcagagttccagcgttattatgacctgtgatgatttacatcagataggattcacaccggatggtgcttcgtgcctcacaacgtatatgcgctgtggggcacaagctgtcttgtaaccctgcgtttgccaagtgggcggattcttttcttataaccctgcgtttgccaagtgggcggattcttttcttgattcagcggagaggacaaaatgattgaagtttatcacattgaagatgataaggcgattgcacatgcggtcaaagaatatcttgagcagcacaattgccgggtttcggtttttacaacaatggaagaggccaggcaggccatggtacgccaggttcctgcaatggtgctggtggactggaacatgccggatggacagggggacatgctgtgcagatggatccgattaaggtggagggagcttcctgttattttcctcactgtacgcggtgaatcccatgatatggtatcgggtttcaggaacggggctgatgattatgtggtgaaaccatttgaactggaggtcctgtattcacgtatctgcgcattgctgcgcagggcaggatatgtatctgggcagtatcttacctgtgacggtatcacactggacacgagcggaatgagggtattctgcgggaatgaggaagtcaccttaagccagccggaatatcaggtgctgctggttttattgcagaataaaggcaggaccgttcccagggaaatgcttttagaacaggtatgggacagcaacgggaattatgtgaataacaatacgcttacggttaccatcaagcgcctgcgcgggaagctgcaccagccctcctgccttaagactatccgcagctttggctaccgtatggaggactccgtatgattggacagaagaatatgggaatactgctgggggttatgctggcagcctgcctgctggcatcgtccgttacagccgcagtcatgacagggctgaataaccggacacagttccagctgctgggcagtgtgtgtcagggaatccttaaagaaaatccagatttagaacagaccctgtttcctgttttaaaaagaattaaaaaccagccggcattgggtgaggaagacaatgtgcttctggcatatggctaccgggagtctgactttctgaaacacacatccggatacggcatccttcctgcaacggcgggctttggcattggggcgctgctgctttttaccgttttctggtactggcgcagaaaggaggccatgcgcataaaagagctgacagaataccttgaaaaagtggacacaggaagcccgggccttctcctgacaacaaaagaagacggtttctcacagctgcaggatgggatatacaagaccgttaccatgctgtatcagacgagggaggctgccgtaacagcaaaaaaagggtttgcggaaaacctgtccaacattgcccaccagattaaaacacccataacggccatttccctgtgcgcacagatgatggaaatacatccatcccaggattacctggcacaggtgcataagcagctgggacggctgacccatctggaggaggcattgcttctcctgtcacgtcttgacgcaggaacccttcccttgaaaacagaagcagtggatgtctatactgtggtgagcctagccgctgacaatttacaggaagtgttcgatgccgccggactgtctgttgatatccctgaaatgggggaaatggagataatggctgacctggactggaccatggaagcattgatgaatcttttcaaaaactgtgcggaatatacgccgccagggggaacggtccattgtgcctgttcccaaaacccgcttttcacggaaatcatcctatgggatgaaggtaaaggatttgaaaaggaagatatcccccatctgtttgaacggttttacagagggaagaatgcggcggacaatggaactggcatcggcctctccctttccagggaaatcattgaacgccagaatggcacaatccgggccgtcaatcaaccaggcagaggcggaacctttgaaatccggttttacagtcactaagcagtcactttggcctgttataatgaaagcaaagttaatataacagggaaaggagcagaaagcttggaaattttaaaatgtgaggatttaagtaaggtatatggtgccagggataacaaggtcattgccctggataagattaatctttcggtccaaaagggggaatttactgccattgtgggagcgtcaggttcaggaaaatccacactgctgcatgtgattggaagtgtggacaagcccactgaggggagggtcctcatagagggcagggatattgctgccctgaatcccacccagtcagccatcttccggcgcaggaaggtgggactggtctaccagttctataatctgattccgaccctgacggtccggcagaatatcctgatgccgcttctgctggataaaaagaagccaaaccaggaatattttgaccatattgtaaaatcattgggcatttctgataaactggaagccctgccgggccagttatcaggagggcagcagcagaggtccgccattgcccggtccctgatttaccgtccggccctgcttctggccgatgagccaacaggcaacctggaccggaagaattccagggaaatcattgatatgctgaaattatccaaccaaagcttaaaccagaccattctgctcataacccatgatgaggccattgctctggaagccagccgtgtcataaccatagaggacggacgtatcataagcgaccggaagcgggggtaaggatatgtggagggattattcaatcagttatattaagaaaaaccgggcttccagcatatccatcattgtggcagcctttatatcggccttattcctttcttttctgtgcagtctgttttatggtttctgggtgtatgaggtagaagggattgttttggaggaaggggactggcaggggcgtattacgggtatcatggatgcggacgatttgacgatgatacagagctttggtaatgtgaaaaaagccgtggtcaataaggacttgtccaatggacaggaaaccgttattgatatttattttgaggacgccagaagcattttccaggacatgcccctgattgcagacaggctggaggttgaggaggatgcggtatcctacaatctgctgcttttatccagatacctgattcatgacccaaaggatgaatcaccgccgcttctaatgacattttacctggtcatcctgttgattgtttccttttccctgattctgatcatccgcaattcatttgcaatgtccatgaatgcgcggatacaccagcttggtatattttccagtgtgggggcctcgccaggacagatacggacctgcctgatacaggaggcggtggtgctcagcctggcccccattctttttggcagcattttgggaatcgccctcagctttggcgtgacccaggcaattgaactgatagcggcagatattccaggcaggcatgaagctggtttcaggtaccatcccatggttttcggggtcacaatcctgtcctcctttcttaccgtactgtgttctgcatggcttccggcaggaaaactgagcagaatgacaccattggaagccatccgcaatactggtgagtggaaactaaaaaagaaaaaacattcccatatcctgcagttcctgtttgggattgaaggcgaactggccgggaattcaataaaggccaggaggaaggtaatgtatacctctacgctgtccctgaccctttcattgctgggttttacgctgaccttgtgcttttttaccctttcaggcatcagcacaggatatacttattttgaaaagtatcagtcagtgtgggatgtcatggccactgtggaagatacggacatagaagatttcaggatgacgcaggaatggaaggagctgcaggggctggaccgtgtaaggaacctggccgtgtaccagaggctggaggctgcggcccgcatccctgaaacagggcaaagccgggaactggccgcccttgggggaatcggcatggttgcgggtcctttggctgtgaaagcggatgatgcatggctggtgcaggcgcctgtagttgtgctggatgatgacagcttcatggaatactgcaggcggattggagcatcaccacggcttgacggagccattgtcctgaaccgtatatgggacagcctgaacagcaatttccgatatcccagatatattccgtatgtggatgaacgccttgggacggttgttctgcaggaagccggggagacaggggatggaacaggaaggacacgggaaggaaacgggaaaaatacaaccgtggaaatcccggtcattgcctatacgcaggaagttcctgttttaagggaggagtatgacggtcatgcatttgtgcagtttgtcccattgtctttgtggggggagatatccgggaaaataggggaagtgaggcaggataccagtatacggatactggctgcaaagggggcatccctggctgatatggatgcgctggagggcgatgtattggaactgcttggcaataagtatgggattgggattgaaaaccgtatccaggagaaaatcaccaatgattatatgattttcggatatcagctgattcttggcggcctttgttccatccttgcgctgattggaatcgccaatgtgttttccaataccttgggcttcctgcgccagagaagacgggaattcgcccggtatatgtccataggcatgacgccgtcaggaatacgcaggctgttctgcatcgaagcattggtgattgcaggacgcccggtactcattaccctgccgattgctgtggcagtgatgggatacatgataaaggccagctatttagacccaatggaattcatggctgaagcaccaatcataccaatccttgttttctgtctgtccatctttggttttgttgcactggcctattatcttggtgggagaaaggtgctgcggtgcaatctgtccgatgccctgcgggatgatacgctggagtgatttccggtttcatgttttggaattttatggtatagtgacagggggcaatggacctgtcctcctttacccatatgcccatgaataacagagaaatatagagaaatgacagagaggtaatgactggcaatgataaacagagaagatatgctggaactgacaagacggatgacgctttcacggacctcctttacaaggatagcaggatgctatgtggacagggatggtgattttgacgggagcttcaatacgaatttcctaaagctgtcggcagcagagcggacaaagaaactgaagcttgcaaaggaaatccctttttcaccaacgaatgtaaacctgaagaaatatgaatttacccagagtatgcgcaaaccaggcagcatgtggcagctgctgatggcaatgaacgaatgcggtctgaaaaacgatgccttgatggacactttctatgatgttgttatggaaaaataccgtacatcttcagattataccatccttgttttccatgaccggtatgatatcccggcaaaagcttctgataatgaaagactctgggaatcagaagaagtgtttgaatacatgatttgcgccatctgcccattgacaggggagtatgagccggggaagccggagtgcggatttttattcccggcctttacggacaggagcggggatttgaaccacattgcggtattccaggcagataccggacggccgcatgatgaaatattagaggtgctggggttgatgggttgatgtccggggttaatggaagatggttggagggcagaggagaagagggatgctggcaaataaggggaagaaagcaattaagaaaaagacaaaagataaatatctgtgtgcatttttcctggtttatatggttgtattgttccgcattactgttttccgttcaaacttcagcctgtttcatgtcatgaagaacggaacaatcaacctgtccttgtttcaggactatattcctttcatcaggcagggaagatggtttctgttcctgtacctgtttgtgggcaatattatctggtttgttccatttgggagcatgcttctgttatccggtaaggtgaagggaatctggagtgcggcattatgcgggttattactatcctttatcattgaaacactgcagtatatatttgggacgggcgtgtcagaactggatgatttggtattaaatacaatgggggctggattaggggcggcagtggtacggctgtatcggcattaccaatgccgtctgggacggaaacgggaagtaccgcaagcgtcagcggatcagaatgggggttaggatgaaatactttggtaatggattaagtgaactgcacaaagagttgaatacaattatccgcaaagcggataaatttgaggaggcaaagacactgttttttgaactgcattccaagctgcatgtatcatcaatgacaggggcagaacagaatgaaaccgatagtctgcttggtgaccttatgcccagcgaataccgtatcatgccaacctcgaaagatgaaacaattgcatgggtattatggcatattgcaagaattgaagatctgaccatgggaattcttgttgacgggggagggcaggtgtttgacagcagatggaaaagacagctgaacgtccacatttcagacacaggtaatgctttgtcagatgatgaaatcatggaattaagtgccgggctggacatgaaagaactcattgcataccggaatgcggttggacaaaggacacaggatattgtaaagtcgctttctgcagacgatatgaagcgcagggtttctgcccaaggacttgaggctgttaaacagtccggcggtgtgacggaccaggaagagtcattgtggcttcttgacttttgggaaaagcaagtggaaacagcatatccgcgacaataagaagtgctttcgctgtgcgtagcgccagatttcataaatgatatggtaaaaaccatgtgtatcggaaaatggtttaaggtgcttgggcataaatagggtatgtctttaactattcgcgaaacaacactttaacgaatagttagtggaaaatctatgttatctatcagatatctgtattgaatccattatgaaaaaaattgaataaaggtggtgtctgtatgtccgttgcgtcctcttctgacgctggttagatgttactgcgctacaggaacttctggatgattacgaatggcaactgatacaatcctctgatattgtacagaatcttatgttttagatggtatcctataatacttgtaatttgtagattgaaaactattcgttaaaccgactcatagtcattcctgggccgtcaattatttgcaatatggaactttaacgaatagttaacgtaatagttaacgcgaaaaaggtgtatggaaacaatttcttgtatgttcatttccctgtatttcttactcctttattcagttccgctcattttcgttccattcactccattccgttccgtcctctaccgctttcggataaacgtaatcacccagtcatcctcgcgcagttcatagcgagtcctgcagaaagggcagaaccgctctttggtggcatcgaagctggcgccgcagttcctacagctcacctttttgacagaaaaaccgtagtcctgggggcggctgatattccggcataaccccacctgaaagcaatcggatgtccgctttaatccgccgccctggcagtacacgtctgtcatatacacattcaggtccagatggcagtattccccttcgatacggctgccgttcaggctgacggcgccgtcaaactgggcatccacaatattatcaagcccgctgccgtcaaattccgggccgtcatacacggcgagcctgctcctgtcatcggtaaaaatgagaattttcagcaatccctgtaccttaccgaagaaatattcaaatgtaaatcccggatcaaactgcttcataaaatccgtcagacgtttcttggccgatatctggcctgcagctctgggcgccatcttaaaagctccgccgaacacccgcaccagaaggcggatggacagcgcgaaatatccgaacaccgcgccgactcccacggtgaaggccagggttataagcagaagaaacagattttccccatgaatcatgtccaagaccaaccccggcagacggagcaaaaagctgattgcccctcctgccgccatccatttaccgacacggttcctggcttcctgctctcccatcccgtaatccggaagaaaataatagtttgtgaccttcggaaacaggtctgacataaaaaaacgggtgtggcagtaaggacatccctccagcaggacacctacggcgctgattgctccgcagttggggcagacataagatgtctggatatcttcctgattgttgagccaggttatgacggtatagagctgttcatcatccccgacggtcagacatttttttccatccctataataatccgtttctctgtgaaacgcattccagaccagcttgttggtatagcgcgtatcggaaaaaacagctgtggcagccgttccttgccggacctgccgtttcgtcagccggaactccattttggtgtgatgcttttgcaggcgttttttctgaagctccaggccgtaactgatatcctggtttcccgtcacaggcgcggtcccattttctccccactggcagagctgggaagcaaactcctcgtaaatctgctgatccgtcttttccataccccaattcccctttaatctttcctgaataatagtcaatgtcctaattatagcatagggttcataaaattaacaggttttcattaaggtgttcctgcccgattccttttgagcctactcattggtgtcataccccaactcatcacacataatcatataattgtaatcccggccattgagggagtcgtattccccaccgaaataatcgttaccgatttccaccaatggaatactgttcatgcggtatgtatctacctggttcaggaacagatgcatccgttcccacaacggtttctgctgctcctcatcaacatcaaccgttccatagttttcctccccgcaccgatatgtacgctcttcccctgtgtctgacagggaaaatatcttatatatatagctgcccctgccctgccacattattggtgaaaactgcatcaggtagtccctgccattctcatggtacagataaagccagttccagcctggatggggataggcggcccaggattcatatagacattcaattgtatctgtttcctcacgcctggtataaacgttgatttcaatcataaaattgaaaccggtatatccaatactggggtaggaggaaacagacgggtgctcagtcactgtattacgaatttcaaaccttgtctgccccaagtcttcatcatgttttctcgcctcctttgctatctccgaatcttcgtccagtggcttaccatctccatccatgacctgactgctgaccacgataagttcgtctcggccgtccccggttaggtcagccagcaatgtactgttgatgccattcatatggtatttagccataaaatcccgataggcctgtaaatcctcatcctgtcctgctgactcctgaggttcccttgtcctccaatcctctttagctgccactgtctgtgtattgcccatctccatacccgccaatttagattcatcataattgcgttctaccgcagttcctgttgccgcagtttctgttaccacagttcctgtcatctccccggtatctgcggctgccccatctgtcccttccgcgcatgccgacaaccccatgaccataaaaaatgccgtcaggtataagcagattctttctttcatatcgttcctccctcatttcatgtatcttcgccacttcatctgtagcttgtcatgttatacccattatacataccctctgtcaatagtgttttactatttttttacaatataatgaattataccaacactgatttctctcacatatctgctttgcggcagaatgttttgggttcttattgactttatctcccaatttgttatgattataagaatggattattagctatattttaatctggaggtacacatgcaaaagaaaatatttccaatcatattgaccgcggcccttcttgtttcaagcctggtctcactcttcttcatccataacctgcaggggaatgccaaggtcataaactatgccggtgtggtccgtggagccacacagcgtctgataaaacaggaattaaaccattcgcccaatgatgcgctgattgggcagatagaaggtatcctggaggaactgcagaccgggcatggggagcacggacttacgcgtctggacagtgatgagttccaggagctgattgtcaggatgcgcgatgactgggaacagctgaaagaggaaatttaccttgtacgtgcaggcggggatacggatacccttttcgaggacagtgaagcgtttttcggattggcggaccagaccgtggttacagcggaaatgttttctgaaaaaagtgtacgttctgcagaaaagagcatgttcatcctgaactgtgcctttgtcctgctcatgattttgttatacatatatagcgcgaatcaggccaaacgccagaagggacttcaggaagcggaagaagaaaacaggaaaaggaaggaacacctgtcccgtatggcagaaggcctgcggggacctatgaatgatatctcggaactcatctatatttcagatgttgagaactatgatctgttgttccttaataagacaggcatggaaaccttccgcgtggattcactggagggaaagaaatgctaccgggtgcttcagggaaaggatgcgccctgtgaattctgcaccacccatcttctgagggaaggcgagaattatacatgggaatttaccaatcctttgaccagacgtcattacatcctgaaggaccgcctgattgaatgggaaaaccggccggccagaatggaaatcgcatttgataccactgagtctgaaaaggaaaagcagcagctgaagttcacattggatgctgaaaaaatggtaaccaactgtatcagcgctttataccagcagaatgatatcgtggaaaccacaacacaggtactgcgtctgttcggaagcttcctttcagcggaccgtacctatatcatatacatcagggatggcctgatgtacaatgattatgagtggtgtgcggatgggatatcacctcagaaagattatctgcaggagctgccgctttcactgattgagaggtggattacctatttcaaccggaaggaatgtatcatcataaaggatttggagcagattaaggagtcagaaccagatgaatatgaggtactgcacggccagtccatatccagtcttgtggcagcccctttggaggaggatggaaaactgcttggatatctgggtgttgacaatcctcctccggaccggatcatgaatatcgccccgctgcttcagacactgtgttatttccttcttctggcccgccgccatgcggaaagccagaggcagctgtcacacatgagttattttgatacgcttacctccttttataacaggaaccgttacatagaagacacaaacgctctggcccatacaggcaaaccggtaggtattgcctatctggatgtaaacggcctaaaggatatcaatgaccagtacggacatgaatatggcgataaggttctggtggaatgtgccagacgtatgaagtcagtattcacgggcgctgatttttaccggataggcggcgatgagtttgtcattatctgtccctgtatgaaaaaggatgtttttcacagcaagcttcgggaactgaaggcccaattccagaatgacccccattatcaggcggccatcggttcccagtggacggaagaggttgagaatctaagccagatcattgccaatgccgatgctcagatgtatgaagataaaaaggaattttaccgcacacatcctgtctcccaccggtaccgccatcacagcgacgaaatcctgcacctggcagacccgtccgtgctacagaaggaaattgaccagaatcattttgtggtttatctgcagcctaagatttcctcctctgaccgttcggcagtgggcgccgaggcccttatccgttatcgctccaagtcagacacactggtccttccggggaattttcttccgcttctggaggaagccgagtccatcagtctcattgacttttatgtattccggtttgtctgtgcaaagctgaagggatggattgatgagggcaggcaggcgtttcctgtttccgtgaacttctccactgcgtccctgatgcagccctcctttgttgagcagcttactgctatctgcagttcctaccatatctctcccggatatatgcagattgaagttacggaaagggtacatgacatggaggatttggatattaagcatctgatttcaaagctgcgccaggcgggatttacggttgctattgatgatttcggtaccgagtacgcgaatctggcccttctgtcagaggtggaatttgatgtcctgaaactggataagagcatgattgataatatctccgtcaatcccaagacaaaggcgattgtggaatccatttcggaaatctgtaccaaactgggaattgacatggtggctgaaggaattgaaacagaggaacagttttcaaccctgcgctcctgcggcgtgggtctggcacagggattcctgttcagcaggcctatttccacggatgagtatgaagaacggtatctgaacacaacaactgacaagtgaggcattgcttttaatgagtaatttatcataccatgaacagatagacagggaaaatatattaaagctgcggggattggtcaaggatctgccgcccttttgcggtgattttttccgcggcatcgagcccaggacttcatccaggacccggattgcatacgcctatgaccttcacgtattctttgatttcctgcaccgggagaatcccgtgctgtccaagctggagataagggacattaccctggaacatctggaccagctgtcggtcacggattttgaggaatatatggaataccttaagtaccgcttcaatgacaaaaagcaggaagtgatgaataaagaacggggaatcatgagaaagatttcctccctgaaaagtttttataattatttttaccgcaatgagcgcattaaaaataaccctgctgccctcgtgcagcttcccaaactccatgaaaaggaaatcatccgcctggatattgatgaggtagcccttcttttagatgaagtggaacagggggaaaaattaacggataagcagaaaagctaccaccagaagacaaaggtccgtgacctggcgctgcttacccttctgcttggcacgggaatccgtgtctctgaatgtgtggggcttaatattgccgacatagactttaagaatgggggaatccgcatttaccgcaaaggcggaaaagaagtgactgtatattttgggaccgaggtggaggatgcacttttggactatctggaagaacgggaccgcatcatcccggaaaagggccataaagatgccctcttcctctcccttcagcgcagacgcatggcggtgcgcagtgtggagaacctggtgaaaaagtatgccaggattgtctcacccctgaaacccattaccccccataaactccggagtacgtatggcaccaacctgtaccgtgagaccggggatatctacctggtggcggatgtcctcggccactcagatgtgaataccacaaagcgccattatgcggccctggaggatgaacgcaggcgcagtgcacggaataaggtgaggctgagggagaagtaggatccatcagcctatctgaataatcatgccatcctggacagtaatcacccgggagctgctttttgctgcttcctgggaatgcgttaccatgatgattgtctggccaatgtcctgattgattttttgcagcagggccatgatttcagccccggtcctgctgtccaggtttcccgtgggctcgtctgcaaataaaatttccggattaccaatcaaagcgcgggcaattgccacacgttgctgctggccgccggataactcacggggcgtatgactgcgtcggtcagacaggccggtaaccctcaaaatctgttccagcctgcctttacagctgcccatctttttgccgtccaatagcaatggcagcatgatgttttcctcgacactcaggttgggaatgagattgtaaaattgaaagacgaaaccaatcttctgccgcctgatgcggctcattttttcatcccccaaaaaggaaatgtcagtgccgtccaagaggacgcggccgctggtcggggtatccagtcccccaagaatataaagcagcgtgctttttccggagccggatggccccatgattgacacaaattccccctgcataacctgtaacgaaacgtctttgagcacttttattgttgtggtgccaagacgaaaatcctttacgatatgttttccttccacggcaatattgcggatgctctgtttcattgaatagacctcctgtcttcctgttcattcaaatttgatttcctccaccagtttcatgctgcggctcttaaggatagggacaacggaaccaatcagggtaatgatgattcccatgccgccagcggtcaaaaaagtggaggcgtccagtttcggcgtcatcgcaattttgggacccgctacaaggaagattgtctgaatttccatataggaaacaaaaatagcaatgaccgaaccaatcagcccagcggagaaaccttcaatcagggtcagtttgacattttggcaattggaaagtcccaccgacttatacatggcaatgctacgccgtttttgcatgtagttgataagcagattattgattactcccacggctgccaacagcaggatgaaataaatcatattgtgcatgggctgtaaaaaggcgcttacggttgacagcgcgtccgcattaaattcctccactgtccggctccaatttgcggttttaccaaataggcctcggatctgtaccattatggcgtccgggtcggcggcagtgtaggcgaggaagtcatagctggatgggttaaaatcggaaaccgcgttagtggaagaaatcaccgcttccacgtccgtggcccttgatttgaaactccccacaatccggtaatcattttgtccggcagcgccagtcagggtgatggcatcccctacggaacgtccggtacgttccaagcatgcctcgctgaacaaaataacccgttcatcggaaaacgctgaaagagcctgttcctccatgtccttttccgtataatgaagccccatcatggagccgtacctgaccaggttgtcggttgcctccaagcggctcaacatcgtgccgtctgccttcatttggtttttgtaaacatagagcggcagcactttttcaattccctccatttccttaacctgctccacaaattccggtcccatcgttccatccgcaaagccctgcagctctgcgtcccggaatacgtcgcccacataggttgttacaaagttaccaacattcgtaatggcaatcacggcggaaatactgataaacagcaatgttatattctgggcagtatttttgttatcccgcatattacgggcggcaagcctgcccacgtttcccaaaacagcgcaatagattacttccaggcctctggaaatcaggtccgtcatcagcggaacggttaggattgcggcggcaatcagccccagcagggagatcccgccagctaggtaaagtgcctttccagatatcagctttggaaggatgattgaggctgcaaaaagtacggttccggcgcctatgataaaacgcctggggatatggttttcttccacatggcccaacactacatccttaatcggtaatctgctggcccggcgcacaggaagccatgcggaaagcaatgagacaatgactgcggcggcaaaggaaaacaggatactgtatgccgggattatgacaggaatctggattccctgggaaagagattggtccatcccctgtaaaagcagtttcagggccaatgcgccaacgggaatcccaatcaggccgcctgtcacaccatacagcatactttctaatagaagaatgcgggttacggctttttgcgttgcgccaatgcttcggaaggtgccgattaccggtaagcggtctaaggtaataaccttatagctgccataaatgataaaaatactcattgtcatggaaaagaagctgatcaggaaaaacggcatggatttttgccgtgcatctgcggaaacctgcgcctcgttgaccacttcggaaacccggtattccccgtcaggcagcattgctgccaattcattttttaaatcagcagtggaagttccctctgcaggctctattaaaatttttgtataaccttcagtactgcctaataatccggacaatgtggccaaaggcacaagggcagtggctcctctcgtatggcggagaaaaattgtatcataagcggcaatttccgcaacttccagagacaccgttttcccttccatctgaagcgtaatggcatcgcccgtttcaattttatattttgaggtaaaacggtctggaaggatgacctgattcccgataaaatccgtgattccgccaccgtttgcaagacggggaggattgatcttacttagctggtttaagtcggcagcaatcaggtcaacggtttcataatagccgttttcatgatagagggccgagccttccatcactcctgcaaccgtccggatgccaggcaattctggaatgatgccgatgtctatccccccatttactgcggttacagaaaccgttgcactgccggctgccccccgcgccaatttccgctgtgcactttcatatgacgcgcctatggaaaatgatacaaacaacagggtagtggaaagcaaaatggataacagcatcacaagggtccgcgtttttctttctctaacattcataagaatgtatttataaatgactttcatgtgaacacctactttctaatggacggcctttttgcaccctcccatcatcctgccctccccttcaatcaaaaaggttggcagctatcactaacatcatgatagtctgccaaccttaatctgattttcaggcaaccttaattaaccttaatcagtcaaaaagacgatttggaattttgtcccggtatcggggatgctggcaacggatatcatgccgccgtgcagcccgataatatccctggcgattgccaatcccaaaccgctcccctctggtttttgtccggtattggttccacggtaatatcggtcaaaaaggtgcccggtcatctcctctcccatcccctttccattatcagatacatcaatttttaattcagtatcagaggctgatacacataaggcgatttcagtagtttcatcgccatgcacaaaggcattgatgattaaattgcgaaaggctcttgtaaaaagtttctggtcaaatgaaaagattatggaatctgccgtgccttcaaaatgtatggtgcgtttttcatatttcggggtattcagaatgtcaatcgccagttctttcagaaaacggacaatatcctgcttttccctgtttagggggagcattccattttccaactgataggtcagctttaaatcatcaatcagcgtttctatgtaagaaacgttttttagtatgattccagcatatcgtctgtactgttcttcactttggccgccagtgtccccgagtatttccgcataacccttaatgggggaaagcggcgttttcaaatcatgggtaatgttggaaatccattcctcgcgcattttttctgtttggacctgcaatcggtcaccggccctgatttcctcgtttaatgtgttcaggctatgatacaaatcacggaacacgcctgaatctttaacagggagatagcagcgccctgaaatttcctggacggcagtggtcagccgtttcatcgcccttgttgtaaaaagcccatagagaacgcctgaaatcagaacaagcaggaaaagagctgacaaaatcggtaagattatcatcctgccgcctgtaaaccgctctccgttcagatacatcgtaacctttgagatattaacaggaaaatataaaatataagtgtacccgctttcagcattggaaaccgtacccatacaagcagttaatccactgtcttttatccggccggtctgacagagctgtaacaaatccatactggaataggccgtatctgcctgttccggtttctgatagctgaatacttcacggccagaaacatctaaaagctgaaggccgattccattgtcctgcagggcagtaatcccggattgcttaatccgggggaccatatcaataaaaataatctgctccttaaattcgtctgtaaatagctggggccagtcgcttcttgccatctggccatctgccttttgaatggtaatcgttaaaaagaaaaggcttcccgctaacaggaaagtgccaagcagcgataaaaagaaaatcatgtatatgtggaatactgtacgatagccagaccgtttcatttaatcaatcctttttttgagcttataacccaaccccttcacggtgataagctgctgcggctgagaagggatatcctcaatcttttcccgtaaatgccgtatatgcaccataatcgtgttgtcacaaatagaactgtattctccccacacctgctcgtagagccgttccttgctgatgattttatctgcattttccatgaggtaggtaagcaggagatattcacggcctgttaagccaatctcctgcccacctttataggccctgcagctttctttatcaatcctaaggggaccgacagttaaactggttccttcctgcaatggggaagcagtctgatactgctggcggcgaagctgggccttaatgcggaataccacttcgcgcggactgaacggcttcgtaacgtaatcatccccaccccaggaaaggccgaggattttatcgacatcgtcattttttgaggataggaacaaaatggagcaataagaaaattgccggatctgtctgcagacttccaatccgtcaatatcaggaagcatgatatccagcacaattacatcgggctggaagtcccggcagattttcaacgcgtccgtcccgttataggctttctggataacacgaaaaccttcttttctcagcacttcttctactaaatcaacaatgtccttttcatcgtcaaccagcaaaattttattttccattgttcaccatccgccctctttcttctgctgcccacagcctcttctgcctgcgtcccttgatatcatgtattccatacagccacttccatggatacattataattctgctgtatgaataatacaagtaaagataatggatattcatttttccatccagtctatttataagtataaaataaattcactcccctgtcccgcctggctgtttacccggatgcgccctccgtgtttctccacgatatctttcacaagggccagacccagtcccgcccctcccacagaccgtgaccgtgactggtcaacccggtagaatggttcaaagatacgctcacactcttcttcggggattcctatgcctgtatctgatatctttatgattatgttctcctcctgtctgctggctgaaatggatatggagccattttcacggttgtattttgctgcattttcaatcaggttactcattgccctgtaaagcatgacgcggtttccaatcagttttattcccgacaggccgctgagggacacactcaggtgctttgcatccagctgaggggacagctcctccaggatttccgcaaacatttcttccggcagcacttcctcacacatttcactctttttttctgctgtcagctggaacaggctgtccaccagacggatcatccgctcggtgttggtcctgacaatggacagcactcttttaatctggtcagccgaagccttttcctccatgtccagtacatccagattcaccagtatggttgcaagcggggtcttgagttcatgggcggcgctggctgaaaaacgctgctggcgtccaaaggaagcgctgactttgtccatcatatgattaaaggagctggctagctgtccaatctcatcctgcctgtcctgatgctcaaccctgcgggacaggttattgcctcctatctcttcaatggtgccggtcagttcccccagcggcttcagcgccttccccgccatgagccaggttgctccggttcccaggaaaagcatgaggatcagccctgcaactccccatatattaaactggttgccggcctgttttatggtaaatgtaatttcacctgcatctgatttatccagctccgtcctggataatacaatatcgtactcagctgactgggcaacaaagcgctgctgcaggttgcggacaaaaatacggtcagcgccaaccaggaacatcccggtcagcatgaccgcaacacatgccatcaccattgctgacagaagagtcaggcgtgcacgaagtgatattttttttaacatttcttctcctccccgccaatgagataaccggcgcccctgatattccttatgatttcatccttggtaacagcaagaagcttacggcggatgacactgatataaaccttgacctgattggaaaacgggtctgcctcactgtcccacacatgttccatcagttcctcggcgctcaccggtctgcccatatgcatcatcagatattcgagtatggcaaattcacgcatggtcagctccagcgggattccgttgcagcttgcagtccttgcatttgtatccaggcaaaggccgccccacatcagggcggcatctgcctgggtgaaagaacgccggagcagcatacggatacgcgcctccagttcctggaaatgaaacggcttggtaagataatcgcttgccccgccgtccagcccggctatcttatccgtaagttccgagcgggcggaaagtatcagtacctttgtgggattttcctgggactgtatgtgcctgaggacttccataccatccatgcctgggaggttcaaatcgagtaccaccaggtcgtagtggttgatataacatagctgggcggcttctgcaccgtcacccgaggagtccacggcatatccgagtttcctcagcccgtagcacaacgcctcccgcatatcttcctcatcctcaataattaaaagcctcatagcacaccatatccttccattagcttatatgattttggaatcaatacatcccgcaatccggttaattgacggaaactcccttagacttagtaacatagaccctgctgccatctgccatctcgatatagcggttgccgttttcatcggttttctgaggcgtcagcttctccctcacagccttaccgtctgcctgtacaatggaaaccgtgacaccatcttccgtatcaaaaaactggactccgttttcactgccttttaagtcaggtatggtcctgtctgtcctgctgccagcggcatctcttactgtgacggtataacaatcctcctgtttcgtttccgctgcaaatgcaggaatcccaagggttgcggctgcaatggctgcaatagccaggctggtcatcattctgtgtttcatcataatctgttacctccggttatattgtatttttattagtactgagatgtgatcacgcattcattatatacaatataaggttaaaacacggttagaaatccctgcccggctaaaaatcctatcttgcaggaaaagtgacggtaaaaacagttcctttccccaacgtgctttctacccggacggaaccacccatggcctcggccgttgtcttcacgatatacaggcccaggccgctggaaccgtccttttccccgcgctccggcgatactttatagaaccgttcaaaaatatggggcagatgggcggcggcaatcccttcaccggtgtctgacacacggagggcggccctgttgtccacgtccctggatatgcacaatgaaatactgcctccttccggagtatggcgcagcgcattgtaaactaaattatccagaacgctccagattttatttttgtcgagttgaagctccagcataccctctgcccgggccaggaaggtaatccccttatcccgcacaaggtcgccgtacttcctgtccgcctccaccatgagcttaccggcagatacccactccggatgatagacagcggtccctccctccatgcgggtaacctcaaacaggttgtggatgagccgctgaaggtccaggttcttgtgataggctatcccaaggtattctgtcctctcctgttcactggaggcaatcatctcatcccccagcagttccagatagttattaagcacggtcaggggcgtcttaaggtcatgggaaatgttgcttatcatttcctgaagggctgcctgggaggcttccagctgttcattggcatggttgagctgggccgtgcgctgcttaaccagctcctccaggttggcattgagccgctctgcctcctcatgggcctgggcgtagctgcgcgacagcatgacgcactggctgaggatcaggaacatgttaggcacgattccagggacaaacatatccccttcaaatactgtttttgtcaacggcccataaaacagataggttaccatactgcataagtacaggagacggtagggatccctgccgatatttccggtccggacagccaggaagatggagatgacatagggaatcatgactatgaacatgccgttcactgctgctgcatagggcagcacacagattcccgccatgggcaggataaaacagaccaggtaaaggacacgcaggaaacgccccagccttatggagaatgcctgcaccataaaaagacagatgcacaggctgtgcagggtaaacagcaataaaaacacccggctgagcacaaagccaatcccacccggaagaaaatactggaccagggcattgctctccattcccagacgcagcaccgtggtcaggcagatcaggctgaaggtcaggtacagacgttcccgcctgcggaaaaaatagaggaacaggtggtataccccaatcagcaggatcccgcctagggcagctgccaccacggtgcgctgccagaacacatggtggatgaggaccgtatcccggcccatcaggattggatagaaaatgccgctgccgttcatacggtaattggctgcctggatgaccagctccagggtgccgttgggggaagctgccgccaaaagttcattgcgtaccccggtaaccgtatcagcgtccgatccacctaccgttccggcgccgtagaattcttctccgttaatccagataagggaagatgacatgatttcggggatatggagaagatatacctgcccgggaggcgtcaggattttgagccggtaggttgcatagctaagtttgggataccccatcctggtccagggaccgggcaggtcaatgtactccccgcctttagcagttccctgccggaagtcctctggggtgtagagctggccgtgatagaattcccactgcccggacagtgcatatacctgggaagtaaaatccgtcccgcggacgtcaaggacaccttccactgcctccggcccttttaagacaaagggcttggaggcagtaaaaaacagcgccagacacagggagaaaataagcaggaatatagcaaggaaccgtttcatagtcttatccccgtttctgattttggtaagaacctgtatccttccccgcgcacggtttcaatccggccgatgacggattctgattcttccagcttgtgcctgaggcgggtgatatggactgccacggtattggccgggtcaggcttcccggtacgccatatctcatggtaaagttccgccgccgagaggatccggccggaattgccaagaaggaacaggaaaagctcaaattccttctgcgccagggggatgatccggttgtcaatccgcagaagctggttctggtggtcaatgacaaaccctttcatggaacttcggcgcacctgcgcatacacacgcgccgccagttccttcaggctgtatggtttggtgatatagtcatcccctccggccatcagcccctttatcttgtccgcctcatcgtccatacagctaagaaacaggattggggcgctggtaagggaacggacagcttcacagagttcaaatccgttcatgtccggaagcagtacatccagcaggatacagtcataaccctgccttcccaacagttccagtgcatcggcggcacagaccgcagtatccacctgatacccccgtgcctccaggtatttgcggtttgtccgcagtatatccggttcgtcatcgactgccagcagccggtaggaatgctccatatataatcctccaatttaaaaagtgaatgggcctgttgatattgaatgaattaacggttcatatgagtctgttgatattgaatgaatcacacggttcatgtttcatgaattatattcgaacgcaggcggtttgtcaatcatagaagatcctgctttttcggtgcggtctgctgcaatggataaaaactgaagaaaagtttgatatccttgcggtccgaaatggattcctggaatttcttctgaatccgcctgatgatctgttccatgttctcacaggccgcccccggcgtcatgataaggaactggcagctgctgtacctggtatagaggtcgccgaaacgcagggatgaacagatgctgtccttcagcctgcctgtcaggaattcacgatcctccagtgcgacgaaggaaccgaactggtctgtgacagagatgaggataatctgtacattaagacctgtcctgcccaggttcctttctaaaaaacggaaaatggctaggaatgtccggtagtcctggctgcctgcttcatgggcaaactcaggctcctttagctgcctgcatatgtatctcatatcatgtggcgctgccggcagttcgttccttgctgccgaatccgggtggcagtcctccatggaggactcatagagatacagggcctttttccgttgctgtttgccaatcctcagggccaggtcagcccgcctgtacagtgtccggaacgtgtcgtttttgcggaccaggtcagcgcctatggtcagtttcaggctgtttccgattcccatatccttaccggcctggaccgcccttgaatgaagccgttccaccttggaatccaccagttcattcctgtattcacctggtatgaagatggcaaattcatccccgcccatgcgtccgatgatatcctttttgaaaaaaagaaatcccatgatacgggccagctcctgaaggaccaggtccccggtcagatgtccgtaaacgtcattaatatccttgaaatggtcaacatcaagcataaggaagatgccgccctttttatttttgagtaagtctcccacctcctcttccattgctccgcggttcaaaagccctgtcagtgaatcatgtctggcaagtatcctcagccggtcattttccacctgcagttcatccatttttttcattttctcacccctgatatgtagtagttgccgtaagacagtgccgggctggatgaacagatttgttcatcttcccataaacgacgaaatgcgaacacgtttttcacgtatccgcatttcaaatctcttattgatagctttattataacagaatatatggcatgattcaaccgtgaaatttccactcggctgccaacttatagaaatttccactcagccgccaatccataaaacctgcaaccggcagccaggcatcccgtcccttactgcggtgcaaccggcagccaggcgtccaacaccgccttatccttcctgactaccaggccgctgccgcctgcatgcttcacatcctccaccatactcacaagaagaagtggcgcgggctgtcccgggtccgctgtatagacggcaaaccatcccagctccgttccgctggtatcggtcttggatgccttgatttccgctgtccctgtcttgcctgccagcgtaaggtcctccctgtacgcggcccgtcccgtgccttctggtgaagacaccacctgcttcatggcattttcaatcctgtctgtgatttcaggtgtaaatacaccaggaagccacacctccggttccatgtctttgtcatggaccagccggggtttcatcacatttcccttattggggaacatggtatagagggaggccagatggattggattgaccagtacctggccctgcccgtaaccgctgtccgccagctggatttccgtctcaatgcgctccgtattggaatactgggattgggccacggcgatttcaaagggaaggtcctggttaaagcccaggcggtcaagtccggaggcaaaggcatcatatccggtttccagtgcggcctttgcaaagtaaatgttgtcggacagcaccatggcgtgttccagtgtggccgggttggtgttgtggagggtggtgacatgataattcccccagctttcgtccttttgccagctcagcccctcttccccataatcacggtccgggtccagggttcctgcatccaggccgatggcgcccgttatgggcttaaaggaggaaccgggagcaaacctctgcctgaaacggttcagcagcggattgcgcccatccccgttcagcgcgtcccacttttcctgggacatacccagtatgaaatcattgttgtcataggacggcgtgctcacaagggccagtacctcgcccgtataaggattcatggcgacagaacagcttttatcctccttaaatgcctgatatatggcgctttgaagaccgctgtctatggtaagggtaatgttcctgccgtcctgcttggggatggctgccagcacccggttcatggaaccgtcttcccggatgatggcaaccgtgcatccgttggtgccccgcagttcattttcaaacagggcctccatgccgctccgcccgatgacactgtcagtcagatatccttccccggcatgtttttccaggtcctctgccgtcacgttctgtacatatccaatcagatgggaggcctgctccccaaggggataggaacggaccggcgtatccgtgatcatgatgccgggtattgtcagaagctcatcctgaagggcgcggtcctgcaggttctcctcacttggcgccccggacttaagattcagctcatctacctttttaagcgtctttaagggtaccagggaatcgcctttcacccatttcgcgccaagttttttttcaatgccctccgtggaaattcccaggagggatgaaaggtgctccatgtcttggccaggctcggcgctcatctttccaggaacaaggccaaccagggatgcggcgcccctgcctgccagaagcgttccgttcctgtcatagatttccccgcgttccgccttttccgtatacacccggaccttatctgttttgctgaactcaggaaatatgacccggtcattccaggacatatggtaatatccctcctcatcccttacaaaggtcacctgattggggaatgagactgcacctgccactgtatccaggctcatctggtaattcaccacggcaatattttcctgcggctcctccacgcttttgatgtcagcctggatatgggaggcctcaatgccttcatatatgttctgattgcgcgcaacaaaatcctccaggcttatctcccggcggctctggtcatccagcataccgtacatttccccataactgccctgggacaggaaggagacataccggacaaacagttcatccggctttgggatggctgcctgattccttgcctgtatataataataagatgcgccgcccatgccggcacctgccagtacaatcagcacaagggccagtatgagtcccttcccgcctcttcttcctctccggcgggtccgtcttttcatgcttcctgtcatttaatgcctcccatggtttttatcgtcatagaggaggtagcggaccaatataaggcccagtcctccgacaatccctattaatacatacagaagtcccatttctgccgtgccttttccgccgccccatccctggcttatggaaggatccttaaattggcgggtgatatcatttccatccttgtccagcaactggatttcctttgcagaaaggcggatctgtgcattatccttaaggcccagttcttcccgcacttccttaaggtccttgagccataggaaatccggttcttctatctgataaatctgctcataggacgtttccgccccagtaccttcctctgatgttatataggtaatccggaacgcgtccatatcctggcagtcatcgcctgccagcgccagcagttccatatcgcctcccttaacccgcagctgttccgcatggattccagcggtgtatggaaacggactgagacttgcatccaccggacggtatctgccgttgattccccgtatcagatggacgaggccatgaatgttatcctggtccccggcaccgtagaaaatgaaaagatgtttatttactttccgtgacgcaatcacacgcagcgggtcaccgggctggaccgaatggcggctgttgttcccagcggtatctgttatataatcagcaaccgcctccttctgtcccttggcagtatcggcataatgaaattccgaatcatacagcgcccatatgatgataagggtgaccaccgcggtaattgcggcaagaagacgccggaacctgttatccggttgtctgttagtggattcagtcatgatacgttccctccctgcggttgtttttcctgaaatgtacaggtatagtatactatatccgcggatgggagttattaaatatttattgtgatttatcagctatttttctgtactggtacggggaatgtccggggatgtctgttgtccggcgggtttagcccagcatgcgatggcatacccgttccatacaggcgcgggaaatcccgcatccttccagaaaaccttttatcccatgggggtaggatgcaatatgattataagctttgtcaatatcctctgcatctgacctgaccaggtagtggtatccgttctggctcagataggcaaactgagggttcctggtcagattcgtgaatgactgcatgtaatttgtctcgcagtcctgtctgtcaacacctgccagcatcagcagcattaaagccaggaccccggtcctgtccttccctgccgtacagtgaaagaggatacagccatccggggcctcatccatctgccggaacagctgtcggatcacatccttgcgttccagcagggagagataaaggctgcctaaatcctgcaggctgtctaatgcccctgcctgcccttccggcgaaatgtccgcctccatgaacgggatatggcagtacaggatgctatccagcagttcctggctgtcaggccgttttttagtctcccctgggcttcgcaggtcaattaccgttgaaaggccgtaagccagcagcatttccctgtcctctgcagtcaggccggacagctggtccgaccttaaaaacgcgtgccacgcagtctgatgcccgtccattgcaggcagtcctcctaattcccgtacattctgtgccccttttaatgggagcctgatccaattccgtttcatattcctctcttatcctccatgtaatccgtaacaatgatatcatctaacatgcaaacgctgtccttccattcctgtcatatcacgctgctgccagcagtccttaccttgcgaaccttccccttgatggtctttgtctgaagctgctccagcaccatggggcctttcctgttgagtatctccacataagtaaggctttccctgatatcgatgatcccgatatcctctgcctccaccccgtcaatgctgcatatggttccaacgatatcccctgtccgcatcttggatttcctgccgcccccaatggacaggcgcaggatggaatggttcagggctgcgtccttacctgctttgggcgctgcttttttccgttggagtgcccagaattccttttcctctgcctggtccggttcggggagggggttgaccggcagggtggtttccatatactcttctacttttttaagcatcctcagttcatcctcagtcacaaggctgactgcccgtccggactgcccgttcctgccggtgcggccaatccggtgcacataggtctcgcgccctgtcgggaaatcatagttcaccaccagggaaatgccttcaaagtcaacgcccctggcagccacatccgtggcaatcaggtagcggaacccgccacggcggaacgcgtccatatgcttaagcctctccgcctgctccatttccccgtggatcataccgcagaaaatacggtccctgcgcagcttctggaacagcacattgaccatttccctggttccgcagaatatcatgcagctgtccgggttttcctttatgagtatgttcttaaacgcgttgtatttattttcctgcaaaacctgatacacggactgttgggttgcaggcggcgccttaacctcatcttccatggaaatgaacactgcttctgacacagcctcacccatcagttcccgcacctgtctgtccagggtggctgaaaacaggaaggtgctcctgtcttttggaagcagggagaggatttgccgcacctcatccagaaatcccatgtccagcatcaggtccgcctcgtcaatcaccaggaaacggacctttgaaaggcaaaggctgcccctgcgcagatggtccatgacccgccccggggtacctgtcacgatatgggatttctgtctcagggtctgaatctgcttatcaatagggaatcctccgaacacagccgggaccttcagccgcttcttccttcccacgaggaagatctcgcggcttacctgtacggccagctccctggtcggttccagtacaagggcctggggaaggttttcttcccagacggcctgctcacagatagggactgcaaaggccagtgtcttgcctgtcccggtctgggaacgggcggcgatatcctgtccgttaagagccttggggattacggcctcctggatgggcgtgggcgtcatgtagcccagaagtgtcagcgcgtcaaggattggctgtgataaattatatgcttcaaagttatttgtcatatggtctgtttgtcctctttctatagtcctctgttgtccactatcaacatgtttaatttctgccatttctgcaattccttcctggtgatgaggagctgctgcttaaagctttccgtgtgctcctggggtgtcagggtcacaaggcatttgaatgcacagggcattaagtcggcgctggatatcccgcacagcagcccatccgtggaatcccggatttccaggggattgaagatatagagcagatcctcctccagggcgttgcactggttcacaaaggaaaagcgtatgagcatatcactgtagaccacctttccagtataatatatctcactgcttcttcccgtgggcgtcacggcgctgatggacagggttgcctcaaagtttcccggcgagttttccctttcataaatatcgatgattccgtccttcagccgtttgtaacggccgtcataaaaataaaaatacagccgtttggcctggtaaaagggacttttggcagaatggttcaggagctgcttcggggtctttggaaccggcgggctaaaatccatcagctgtcccggactgaccatcagcacatccgctatctcagacagggtctccacgtccagcgtaatctcgccattttcatatttgctcacactggccctgcttttgtgaatcaggtccgccagctgctgcagggtcagttccctggccttcctgtacatgcggatgcgcccgccaatgtgttcattgattttgctcatgattcctcctgacctatccggaaagtttctttaaaatatattcttgtccgcatctgatgcgtccagttccctatcatacactatcttcccggataattctactcttaataaacttttatgcgaaaaagtttattttaatgaaacacggacacatttgatttataaagcaaatctgataaactatttgaggttttccttttagataaggaatcataaaaacataagaataaacgggggattttatggataccaaaaagaaaagcagcttcagcggctccatcggatttgttttatccgcggccggaagtgcggttggtgtgggaaatatatggcgctttccctatcttgcagccaaggacgggggcggcctgttcttaatcatctatctggtcctggtgcttacctttgggtttacgcttctgaccacggacgttgccattggaaggaagacaaagcagaatgcgctcaaggcatttggggccatcaacaaaaaatggaatttcctgggatatctcacattcctggttcctgccctgatcatgacctactattccgtaatcgggggctgggtcacgaaatacattgtcacttacatgactgccaggggcgcggaggcggcccaggacggatactttacatccttcatcacctccaaggcctctcccgtctttttcatgctggtattcctggctgcaaccgcctttatcgtgtaccggggcgtggaaaaagggattgagcagttttccaggatcatcatgcccggattgattttcatgattgtgggtattgcgcttttctcacttaccctcaggtacacggatgggaacggggtcacacgtacgggacttcagggactgggggtatatatcattcccagcctggatggaatcaccttaaagcgcttcctggaaatccttctggacgccatgagccagctgttcttttccttaagtgtttccatgggcatcatgatcacatacggttcctatgtgaaaaaagaggtaaacctgaaccgctccttaagccagattgaattttttgacacgggtgttgcgttcctggccgggcttatgatcattcctgccgtgttcgtgttctcaggaaccgaaggcatggcttccggcccaagcctgatgtttgtgtccctgccaaaggtatttaacgccatgggccgggccggcgcactgattggccttgtcttcttcatcatggtggcatttgcggccctgacctcctgtatctccatcatggagacgctggttgccaactgcatggagctgttccacaggtcccgccgccagatgagcctgattattgccgttctgttcgctgccgctgccgcagtcatctgcatgggatacaatattttttactttgaaatgcccctgccaaacggacagaccgcccagctgctggatttgatggattatatcagcaacagcttcctgatgccgttcatctcattgctgacctgtatctttgtgggatggatcatcaaaccgtcctggattgacgaagagatggaagtaaatggaaatgtattcagacgtaagaagatgtacgcatttatgatacgctatgtgacgcctgtcatgatggcggtcctgtttttacagtcagcaggtatctttaccatgctccgcggtttatttacatgataaggcgcagcagatatcccggacagggcagttaaaagttgatatgtattaaaatcattgagaaaatccaggattcctgtgccaaggcaggattcctggattttctttcgtgtcatcggttcagggccatgtgcggccatggatatttacatgaaaaatgagatgaccgggaacgcaatggctgcgatgatacaggcaatggcctgaccatacttttctttatggcagcatatcttagcgccaatcagtggtactaatgagaataaaagactattcacccaatgatacttttccggatcaataagccttatggtcattgcgtggtttgcaagcccgtatacaatcaggattatggcacacgcaggtaggagcagcggatcaatcattcttttcatgactacatcccctttcacggcaggagttgtgcaggcataagcctgtcagttatcgtggtttcactgaatcttccccatgttgggaaaataccggaacaggaccttggcctttatctcatcctttgtcacataggggtcctcccacccacgtgcgtcaatggaatgattcctgttatcgccaagcatcaggtaacagtcctcaggcacttcaaagtggtagtcctttgaatccatggcctccggcagataggactcctgaagcggtatgtctgagccgttgatatagaccttgtcttcccggatatcaactgtctcgccaggcaggccgatgacccgctttaccagccgtgtcttatcctttcccggctctgccttgtgggtaaagatgacaatgtccccccgctcaggtgtgttcccgaaatggtaggaaagcctggaaccaaggatccggtcgcctgtcatgatggtattttccatggaagccgagggaacccggctgtttgccaccacaaaggtattcaggcagaatgcgattactgccgccacgatgatgatctgaagccattccaggatttccttcttcatgccctttggctcctgtttgtctgtatctgtctgttttttcatggtaatcctcacattattttttaatctttgatacggtgtgactatccctgcctatgctgccgcctgcccctcctgacatccatgacgatacaaccggccagggcggctgccgaaacaaccgtcacaaccaatatggccctgccgtcaggattggccagccaccgttccccggcaagccggtacctgatatggcagcaggcaaggccgttaatgaaacacagaaatgcaatcaatccccacagacgccatttatttgccctcataagcctctcctttcgtgtgaatcctgtgttttatgaaacagaatggataactacttttattctaagttagaaaggaaaatatggatagtatatattctattaagattttatgacaaatcacacaggatcattttttcctgatgaattgcatgccttcgtaaatcctcaccggattcccgcgttccaggcgggtgtgttccagccatgccagttccttttccttctgtctgttctccagttccatatctgcaaggatatcgcacaggcggttcatggccagctttttattcatgtgctggctgcgggcctcggtggacacaaccgatatcccggtggggacatggatgatgcgcacccctgtctccaccttattcacatgctgaccgcccttgcctccgctgcaaaaggtttcaaaacgcagcttcatatcctccctggcatcaggcagctgttccaggatactcacgtcaatgaaccagttcttccgcctgtgctccgggcggaacgggcttttgcatatccagagcacgctgccctccagttcccgcatatcttcttctgtctcaaacatgatggaggaataccctctgcctgtttttccgtggacactctggaccaggcgcatatccctcctctccttttggagctgtctgtaaaataatcccactgccagttcgcattccgccgggccctgcccggagctgatctgtaccctcatatcctcacctaccctttaaatgtgatgagcgggcgcagggttgcgaccacatcaaccagtccatattccagcagtgactccataacctgttccacgttcttgtatgcctcgggcgcttctgcgaacagcaggttggtgtcgtggcacaccacctggcttttatacctggtgctgcgtatggaattgcggtcgtatttgcggtcaatccggcttttacagatgctgcgcgcccatttgcggcctgctccatgggaaatggaatccagggatatgtgtgtatccctgcctggaacacacacataagtcaggcttcccctggaaccgggaatgaccagggcatggtgtccggccgacacgcttcctttcctgtgcagccatccttccctggtctgctccacataattatggcagctgtccgtcagccgttgcgtccggctgtcaacattcaggtaatccagaagcttgacagcggcagccagccggttgcgcccggcccacaaaagcgcattgtcgtgttccgccaggtaagcatccgccttgggggtaccctccttaagtccatccggcgaataaaaacgggaaaggatttcctgcccatagcccctggagccggaatggattaagagaaagatctttccgtccataagccccagcttttccgccctatccacatcatacacctggtccaggcactgaaattcagcaaagtggttgcctgcaccgatggtcccgaaatcccggatgggacacgcctccgcatagggaatgtcacatgggatgtcttccagtccgcgtatggaatttaaacgggttacccatttatccatcttaaatttcttctgttttacctctgtcttaaaaagactcattccgcagccgatatcatttccaatcaaatggggataaaaccttccctggctgagaaccgccattccgaccggcgtcttgcccggatgcaggtccggcagccccacggcccttatgaccccgggcagcctgcccacgccgcagagctggtccttggcagcctgctccacccaattcttctgattactgatcaatatgcaattttcctgattcaaatcttaaatctccttcataagctgacaggtaaaaaagggtacaaaaaaacacgacaacaagccgtgcgcaaaaaaacatatcatacgccagtccctgtctgatttacactgttatcttgttttcacctgatccatctgatttgccaacataacaaccactcctttgcttatgaaggaccgccgtcccacttattctagaacttactataatgggaaagccggaaaatgtcaaccactaaacagaaaacttttatttgcggttgatgaaatacttaaccagctcaatcacaattacaacggtaagtacggtaacggccgtattgaccggattttcaaacagctttgtgaataactctcctgcgctcatgatcctgtctccattcgtttaataacccttattataatataaaaatatgcgtatggcaaggcgtaaggctgacagggatgaagattcaaacacaaccttggacatgaaggaaatgaaatcaatatcttggacaatatgtacaaaaagcagggggaaggtttgtgtaaatcagaaaaaatagtgataagagaagacattttcaaaattagcattgacattggacataaatgaatatattctaaaagtgaacatattcacttttggcgggagtatttatacataaaagaccgccgggttaagatctggtccggcggtcttcctctatccaatggtctatgagggataatatatcgtttttaacggtatcgtcatggaagaagtatccaaccttcttcctggtcacttcggaatgggcatactggatggaatccagcacactggcatgggataacagaatctccttccccgtatgcgggcagaactctcccagcagtccggctatccgctccaggtaaagctgcgatgcctcccttaccccctcgtagttctttccaacggtcacctggtcctcctgggctgctttggcaagccggacggtcttttcatcccggtcaaaggcattggagttgtcaatcaggtaatcggccagctcccgcggggtgcgcaggttcccgatttcctctgtggaatgccggatgaatgttatggcatgttcattccagatatcagccagcacatcccgctttgtcttataatgattgtaaaatgaaccaatggaataaccggattccttcacgatgtcatgtacgctggtattcctgtatccccgttcctggaaaagtttaagggccgcggccttaatctcctgatgggtcatttccgatttttctttttggcgaaggctcatattgattacctgctttcccgtgttttatctgttccgggttttattatagcaggaatgctgctttttgtgaagataatccaatcaaccaaacattcaaggaggtattattatgggcagttatccacatattttcacaccgggaagaatcgggcatgttaccgtgcgcaaccgtacggtcatgccgtccatgggaaccaacatgtcggaccatggattcgtcaacgatgccattgtcaaccattatgttgagcgggccaaaggcggcgttggcctgattatggtggaggtgacctgcgtggacaccccgctgggcctgaacacgctgaacatgcttgtggccgatgacgataaatacataccggggcttacacgcctggcttctgccatccatgaacacggcgcaaaatgttttctccagctgagccacaccggacgcggcgcgcgcaggaagaatatccacgcccagccagtgggaccatctgccgtgccgatgccattttccttcatgatgggttttggcaatgaggaaccaaaggccctcaccaccagcgagatccgggagattgaggacaggtatgcagcggctgcaatccgggctaagaaggccgggtttgacggtgtggaactccacgcctgcggttactatatgggacagcagttcctctcttccactgccaacataaggacggatgaatacggcggcagcccggagaaccggagccgtttctattccaatatcataggaaaaatcagacgcggctgcggcagggagttcgggcttgtggtgaagcaggctgtcatggaggccggggaacagggcgggattaccatggaggaaggaatgtactacgccaaccgtttcctcaccgcaggggctgacgggattgaggtcatgggaggttcctggaaaccgcagccggatctggacgatatccccagtacggcggataaaccaggacgcatgctgggactttgttccattgtcaagaagaccgtgctctccatgccgggtgaaaagggacagcccgtattcatcggcggcggacgcacatacctgccggagctggcggaacaggccctggctgacggacaatgcgatttcattttcatgggacacgggcttctggcggagcctcatctggtgaactatctggaacatgactgctatgaccaggccaggccctgtatcggatgcaacctgtgcgccgatgaccagctctcccatggacgccacatccgctgttcctgtaatgcagtgctcggcaatggggataatgactattccatccggcctgccgttgtcaaaaaaaatgtcctggttgtaggaggcggcatcgccgggatggaagctgccagggtgtctgccatgaggggacaccaggtcaccctggtggaaatgaatgaccaccttggcggccagctggactacgcggtggcgcctccctacaaggataacctgaaacagttatacccttactatgaaaagcagctgaagctgaacggcgtacaggtccttctgaacaccagggcggatgtaccgtggatcctgtcccggaaaccggacgcagtcatctgggcctgcggagtccgtccggccgcactccccatacccggttttgaaaaacccattgtctccactgccaaggaggcgcttctcggaaaggaaacaggcagccatgtagtaatcatcggcggcggcgtggttggctgtgagacagctgaacttttgcttttgcagggcaaaaaagtgactgtggtggaaatgctggacaccctggcagggaagatggccgctactacccgctccatccttatggggcatttaaagggacatggcctgactgcatatatggagtgtacctgcagggaaatcacggattccggagtcattatcgaggacaaggaaggaaagaaaacggaaattgtctgtgatgacgtgttaatcagtatcggggataaacccaacaatgaactgtgtgaccagctggcatccatggttccggaattttacaatatcggtgacagccaaatgccggacagcttcgcagcctcctcatccgccgggtattatacggcgctggggatatagggctaatacggtgctgggaatatacggcttacggtgctgggaattcagggcttatggcgctgggaatataggactatatgggaactgcgcggcgcagttcccactgacagataaggagggtggaaaatggacaggattaaggacaaggttgcaatcgtaaccgcatgtacaagaggaatcggacgggccatttcggaccgttttgcagaggaaggggccattgtttatatggctgtgcgaagggtggacgcgggacaggaaatcgcagacgcccataacgcgctggggcgcagggtgcacgtggtttattttgatggggatatccttgataccatcaggcccatggtggaatctgtttatgaggcagagggacgtatcgacatcctggtaaataatctgggcggcggggtcaggcccgggaacaaggatatcgtgggaagcgatatggaagccatacataaggcatttgaattcaataccatcgtcacatccctgtgtgcccagtatgcggttccccatatgatagagggaggcggcggaagcattgttaacatatcttccgagacagccgtggtcccccagctgaccagaagctggtacggcattgccaagacagcggtcaatgcgctgaccgaacatattgccgtccagtacggtccccagaatatccggtgcaacgctgtgatgcctccctttacaaaaacagacgcagtcaaggtgcttcccccggagttcatggaacaatacgccagggcggtccctttaaggcgtgtggcagagcctgaggacatggccaatgccgtgctgttcctggccagcgacgaggcgtctttcatcaccggacagtgcctgctggttaatgggggctatacccttccgggggccgattatgcggactccatagcgccaaggacagctggatgctgaggatgacgggatacggatgattggggaagaggtacggtattgcatggattggattcaatcgggcaataccgtacctcttcatattagttccgggtcagcttgattttttatatactttttcaggaaaatcaaactaaagataagaatcagaaatccaatggcgatagaagaaaccataacatgatatggaataaaatcggatttcataaaataattcaagataagggaataggtattattggctatatgtataagcatacctagccttaaatcatttgtaattgaaatcacatagccgataatcagacccatataaaccgcactaatgaactggaccaaattcatatggcttataccaaacaatatggcggaaaaaataacggcataaatatttctgtgataacgttttatactattatacagaataccacggaaaaataattcttctaaaacaggcaggataaggcacgtataaataataatgactggatttctcgaactatcctgtatggcatggaatgtttcacttccaatctgattaaacaagcctgtcccaatctgtggaataagcatgaaaatcagtttatgggacatacatataccaatgccggttaataggcataaaagatatggtctccattcggatgatataaaacattttttaagattggaaccagataaatattttttaaaaaatataatgaacaccatgtaggatatgccttgggttgtatagagcataatagacctagctatgtaatctaatgatgagaagatagaaaaacagagtccatttattatagatgtaatcatttgaaaaaatatccatattagaaatgccatggttttccctcctatcgtacatttctttggtttttccataaagatacattattttttccataatggctggttttaaaatgtcctttcccaagcgaccagaaaacgtgcaatccgaccagtgtaaaaaataagaaatagagtaagccccctatgggatatatgtgaggggctttgtatataacctgccgttctccgtctggggatattcttacaaattgggatggataagcagaacgttcatatgtatacccatcaatcgtccggctgggcttatctaaatattgtattagcctgctttcggcatccgtgtccacctttcctttattccataccttacatacttccccatcccgcgttacctcatataccatattggaccgtattgaagatatgagtatatgattgccatggaattggagataataatgtgctttggtatcgattacaagcccaaaaataaattccccattctggttatatgcattcatatacccatccctgaatcctacaatcatatccccgtcatcagaaacatcaaatactttaagtacggcgtcagtcatatgttcgctgtctgactttcttatatcttctgtatatttgcttatatcttttatttcattttcgtctgatagaataaaagtttgtgcgattgattcagcaggttccgcagcatgtgcatatccgcagcaaaatagaatccatatgattgtcatgataggactgactgccctgatacgccggaagaaggttttcattgattggggcctcctgactattacaaggctggttggcttatgacattcagcctctgttcccatattttccgcatatgtcatcgtatgcgataggcgcattttttgaccatgcttgaaagatatcatctgtaggaactatcgttgcttttctttcgcctacatgaatgatttccaaaataccattattgtttttccactccccgccaaaattccttatgatccagtctccgtagaccgccgcgatatctatcagggcatcaaccgcatcacaaaacagattatcactcaggcggctgatttttagttccaaccctgctaattccaaacggggattattccttttaccggtagttaaaaaatctcgtaccgcccgttctctatgacgttcaagttgtttaaaatattccatatttctgatgggcgtttcatctgtgacagacttacataattcctccagttttctaataccataattacagatgatatctttaaatcctaccacaatcccttcaaagtcatcctgcgttttatagtcataaccaaaagtccaacgggaatcgtacaaatgcagctctttcgtagacaggttttttgcgctgactactcttctgattgggtagtcaaccatgaaacgcatatcaacgtatgtaaatttatcataaatatcaattttttgacttcccctcacatactgccaaccgtttccgtcaccgtccgcttcccaagtttcataacggaatccctggggcatcaatatgggggttatttcattttcaatatacgctgactttgttttataatccacgtatcctcctttccccggccgtatccgcccatatgatgcagatatcccggcaggcttttccttgtttgaatccccagtctcccttcggatgtttcatatactgatccagtccatgtacgcatcccgtacctgggtcagataaggcttgctgatggtaagccagatggaattgcccatcagcaattcccggccttttatttgttttacatgcatgatgttgactgacgttgtcctgtggcagcggataaactgtttaggaagctgttccatcatctgataaaatggtattttgtgtgtgatggtcccggacacggttaccagcgctgtataatgcaaagcagcctgacagtacagtatgtcacggtatgggatggaaaggatggtatctttgctgttataaatgtatttggcatttgaaacacgctccaatgcggtatccatacatgcatgaatccgttcatacattaccggtttcaggataaaggcaacggcattggtcccataaccgtcatacacatatatatcatgcatggtcagaaacgccagcggggtgtgggagccgttcttattaagagcttgtgccgtgtcaatgccattgagctttccatcaagttcgatgtccatgaatataaaatggaaatcgttgaagtcctcttttaaaaagtcctcacccgtcgtgaaatgccggataatcagttcacatttccggttcatggccgcccaggcatgcagcttctcttccagcttttccctgtccgattcattattttcaacgattgcaatctgcatacaaagcattcctaaccatgcctcctttgtgatggtataactattatgatttcaaaggatgtctcttggggatttaatcgatagaatccatcggcacgttcaacaatctgtctgatttgggacagaccgattccatgtcctggttctgttttgcggctctccaatgcctcaccgtcaaaattgtaaataccgtcacagctattcttgatgacaatccggaacatattatccacctgcgttactgttagttcaatataacggctatttatattggataaatgcaggacagcttcaatggcattgtccaacaggttcccaaacagggatgagatatccgcatcactcatggggaaatccctgcagtcatttatggcataaataatatggattccatgccgttttgccttcatgaatccggcggacaacacattatccaaggccgggttgccgctgttggtcagcagacctgcatattctgtaaagccggaattgtcccgtatgtaactaagcgcccgttctacatgaccggattcgaggaacccggtgaccatctgtatatggcccttcatatcatggcgccaggtgcgcagggctgtgactgcgtcctgggcggcttccagttcctttatcctgttttcatcccgctgctgtttcatcagaaggcggttcctttcctgacagacctttgcaaaccagatcatgatactcaatgttgtaatggtaaggatgataatgaacaggtaggcaatatctgtcatgatggcaatatcctcataaacctccagggagctgacggttatggagatattggcaaactggtccagtaaggccagggtagacagcgtcatggcaagaagcagtatctgtacctttcgcggcaggacggattgatttttcaacagctggataaggcctgtggcaacaatgaagcttatgatcagatataatgcaaccatataatagcgttcagcagacggcttcaatagctgttttatgctgatctgcaataaaagatccgttatgcggaatacaatatgctcggatatcagggcaaccagcatataggaacagccgcatataagctttcctaccctgcgccccgggaaacaggtataggaatacaggatttgcagtgcggtgacacaggctaaccgtaaaacagggtggaaatacagtgaatcaatccacgtaattacaaatgccaggaagatcccacccatcagctgacggtaacggtaacggccagtcccacctaaaatccgataaaatagataccagcagatgcccgtctccacaaaattaatggctacttctatcattttctcatgttcctccaccaaatacaactataaccgggtatcaactcatgcaaaaaaaagataattcgtgcaaaaacccaagttaattctttcaaatcaccaatcaggatcagccaccgtacttttaagtatccgccgcacctaccaatataataaaagaaaaatataggtacatcaatacaaatccgacaattagattcccaatgcccttcctccttgtccggtaaaacaatcaaggctggataaattaatatccagccttgattcctcaaacacgccctaataagaggaatatcaaccactatccatagaaaaatgttttgttctcagaagattgaatatagaaaatataaaacaacggcacacaataatgcagttagaatgaataaatatggaatgatctttatatttttatcctctctggggcaataaaagtctgttatatcattcgggttatagtaaatatccacctcgtccccaggctttccaactgaaagaaatgcataaggaacccttgaatccataccattacactcctgattcccaatgctgaacttatatattgtgaaacgatgtggtatggatggcgctgtaatatacctgttatgagtgcgtttaagatactcaacatagacacccgtagatagataatcaatctgtcctatggttttcttaatacatctgcgtattacatccatattcttttccttaattgtgctatatgcattgaaaagtattatgataatagatatatagattgcagtaagcatgattaacaatccaatggaacaatccgtcatgatatctccgttcatatgttgaggataagtgattaaacatagtttattttccttaaaaaacttagtacggtctttttgtgttcatatggaacttttgcaaaaacataagtattatcaatctggattaccagttcataagtatcatccttatttcttcttgaatatttataataccggcccacacttaatgtatagtttttccctcctgcctgttcccttattttttcttccatgttttcccttaacatacgggcatgttccgttgagtctgtttcagcgtattctatctttatgccatcatctatatatacctctccggaatgaaagatgaaattgtccttcgcctcacttgtatcaatccattcatatccattcatttccgctattctttttaattctgcaaactccataggcgattgtggagttatgtttttcagaataacataaccaattgacaagattattaatatgattaaaaaaaatggaataacgaatcttttccgtccataaattagatacacgtttaccattcccccctttttaatacttacaatataataaattccgtgtattttcaatggatttgcatgaaaagcctgttttctgcatgaatagacgtgatggcatgcttaaacttctgaaaggattttttgaatccttcttcaatttattccgcgggcaatcgttcctgcctctcccgcgccaaatacctcctcaaacgcccgcaggcactcccctttcctggagcggtccatgacagcaaacaccacggtatcgaaggtatctgcaaagtatcctgtcagcagttccttccaccagctggctatcctgtacgggtcattgcggaatacgccgcatccgtaagccccgaggatgagatgacggtgattcatctgcacgaacagggacagggccaccttcatgcgttcatacatggctgtttccgccttatgtatatcctcccccttctgcatcacctgccccatgttgacagcaggcagggtaagtacggaagctgtcacaggttcctctaaaagttcaaaccggccatcacggaaaaatacaacttcaggggaatagatggcatggttggtatatatcatggacgggcagttccggttgttctgatagtattccgggtgtctggtcagggtctggtagagtccgctggaagcagctatgctctcctcctgtgccatggcaccgtttaagaaccctcctccgggattcttggcgctggcaaagttcagtaccccgggatccgccaccccatcccctgacagcctaaggatggcatccacggtagaacagttcatggtcttcattacaggtaacataccggaaggttcccctttgacgtatgttgcggccagtgtctctgcctgttccggtgtaaataaaaggctgttgtccacagatgccctgtgctgtttccttatatcaattatcctgccatggatttcgtaggttccacgtctcatgatttccagtgtttctctggcagttgcttttctatccatacttaaaactccttccattttttacggtacagcctggatggacgatggccctcattccctgtgtaggaatctgtctcctccacaagggatgcagctttcctgcggaaagctgcctttaaaaggcgtttccccagaatcacctcatatacctgctgcagctgtgtcaatgtaaattcagaaggcataaggtgaagggccagtccgctgtactcaaccttgccccggagccgttccagggcataggtgatgatcctggcatggtcaaaagccaggccattgttttccgttatctcatattctgtaaatgtgccgttttctgttttggtcatggatttctcaatgacagaggaaaggcagatgttgtccgaggttaattcaagcttataatgctggatacggacaacctttggttcctctccgtccgtgggaacaggataatccgtgtgttcatccatcaggtagaaggaaatgtggaaccagcgggcgttatccgcgtcatcccctgcttttatccggactttggaactgtcaataagcgccatataagaacaactcatgacccaggtgcgtgggtcgcggcccgggtcgctgaaggtatacagctgttccatgtatacatagttaagcccggtttcttccatgagttcccttctggctgtctgttccgtggtttcgtccggccgtacaaagccgccgggcagggcccaggaacccagatagggatgaacccctctttggattaacagtatgcccagttccttttcaggcagcttcctgtaattatcttctgtttcctccaaaaccgtgaaaatagccatgtcggcagccatcgagggccgctcatagtggcctggatcataggattgtaaatactcggcttcagtcaggccattccggtcaagtatcctggtgtccctgtccatccctgtcatgcctccttttcctgttccataaggatatccctggcctcggtcagggcaaatcccaaaagattcgtgcctttccactttaccgggcattgcacatccggattactctttcccataccaattccccagatgcggtcccttgggcttgcctccaccaatatcctgttcttagtggaacgcaggaattcccacaattccggattctgggaaaactttgccatgctggcttgtttgacaatgccatagcatgcattgtcccatgtctctttatcaaaattacggacactccggccgtatgccttcatggcctttggctgctttgcctccaaaatcagtgaaagcatctcctggtcatggaacatccttgccttttccgccatcatgaactgctccgcgcaggaatatgtaatcccatctacttcaaagcgggccatccaccactggctcaggcaggtctcggtaatacgcccgctggaatctggtgtgtggccccaaaagaacaggaatttataatgttgtcctttgttatatgcctttttcaaatcttccaatgaataaaccatgccactctcctccttatggtatcatgctggatatttgcatcaatcgtattgcaatgatagtaatatattgataataacaacttgatactatcatgatatatgattgtggattgattgtcaaggggatttggtatatatgacaggattaaaaaatgaatttaaaaataatgaggtttaagagaaatagtaaatgtaagtgaatatagttaaaaaatgtcacaagattaagaatgtaatagaatttaagagtgttgtaggacagggatggaaataaaatataattaccctaaataagcctaaaaagcagaaatgaacgcaaaaaaaccatttaagtttacataaaaatattatgttaacatattgccatggcaaagctgattttacagagatttttcacacattccattatgcagaccactctcccatcctatgtatccggaatcataaaaaccggcagacaactgcaatccacagctgcctgccggtataaacccatcctatctacagatgaagcctctttaatgaatcaatatcccctgcctgtatgaacggtatggcagatgaaatcttctccaccggccagtcccaccacttcatctcctgtaatgttttgacatcttcatcagaaaaacgtttccgtatcatcctggccgggacgcctcctacgattgtataaggcggcacatccttggtgacaacggccctggttccgatgatggccccgtcgccaatggtgacccctgctaaaataacagcctcatatccaatccatacatcgttgccaatgacaatatcacccttattatcccacgccatgtccggcctcatgccatgtccccactcttcataaaacaaggggaatgtataggtggcaagggaacccatggtgtggttcgcactgttgaacaggaatctggcgccgcatgcaatggaacagaatttcccgatgataagcctgtccttattgattggataatggtaaaggacattatttttttgaaaatccctcgggtcgtggacaaaatcgttataaatggtaaattcccctatttcaatattgggattcccaattacattcttcaaatatacaatctgcgtatctcccgttctgggataaatcctgctgctgtctggaatagtcattataatcctcctgattcatcaattattgttttgggactattccagttaatgcaatgcagagtttcatacaacccgcctccttttctgtcttatatcaaatatattacaggaacaaaagaaggaatggaataccaaataaaaaaatatccagacatccaggcaacctcattcaatgggcgcctgataaaacccgccataaaaattctccgtcttaatcatgttcacaatcacatgcggatcctgttcccgcatcaaatggacgatatcattcacctcataggaggaaaccactgtgtgcagcaggtacattttcctgtggctgtagccacccatggcgtccacgcaggatatcccatgcctgtacgctttcacgtaagccttaatcacgtcctctgcattggtggtggtaatctgcagcgtgacccgctcatacctgtggtggaaggcagatatggccttggtggaaacaaactggaataagatggagtacccagcataaagccatccgaacatatatccgaaaatacaaaggatgacacagttgcctgcaaacacatattcccatatggatttcccggtcttattggacacatacagcgcaatgaagtcagtgccgcctgtggaggcatttccgcgcagcgcgatggcgatggcaatgccgtacaggaagccgccgaacaccacatccagaagcacatcattgaacagcggctggaaatggaacaccttcaggaaaaagctggcaaggaatacctgcagcatggaataaaaggtaaaacgcatgctgatgcttttactgcacaggatggccaccggtatgttgaggaccagcattcccagggacgtggagatattatgtccatataaagaggcaatcctgtcaatcaggattgccacgcccgtgaaaccgctggataataggttggctggccggatgaatgcctggatcacataggtctggagcagtgcggaggcgatgaccgctgcaatggttatgagcctgcgcaccatgatattcttcttgtatttggcaatcatagccctgtctcccctgcttccccaatacttatgagaagtttgcgcacctgctcctctgagaccacatcataagcacgttcattgggagcagccccaaaggcataggaaacgctgtttacaatggtggttgggtcctccacccagtccttgcaggaactgtgcacctgggtaaggccggtgtcatccatcagcttcctggcattaccggcgttaatgccgcttcctgccagaatctcaatcctgtccccatacatggcctgaagttcctttaaaagagccgtgccttctactgccttggccttcagtccgctggtcagcacccggtcaacccccatgtcaatcaggatttccatggacctgtaaggattgtccgtgcagtcaaatgcccggtggaatacggcttccttcccatattcatggatgatggaaaccagcctttcattctgctcacggttaatggtggcatccgggttcaggcagccaaaggcaattccgtccgcgccatggctgaccaggatcctggtatccatctccatcacctcaaaatcctccttgcagtaacagaagccgccgcccctgggacggaccattgccactgtcctgataccgcagtgttccttcacaagctcaagggtgcccagggaaggggtaagcccgcccagatgcagcccgctgtttaactctatccttttggcgcccccggacgcggcctggaccgcatcatagtagctgccgcagcatatttccaacatagttccattcctccatatctgattcacaggcctggccgccagccgttccccgctgtctgctacagctgccccagccggtacaaagccaaagcatatatccgtgcgtttgtcatcaggtcctccactgtcatccattcattgggattatgtccaatccccttctgtcccggaaaacttggcccaaagggcacgattcccggcatccccttggcataggtccctcctgtggtggtaaccggcgtcccgtcctgtcccgttacaatctcatagctttcctgaagcgcctttaccatggggctgtccttttcaaatatgaccgggtcataattcatgaccagctctgcacgaagccctgattccaaagccttcccctgaaccttatccataatctgctggatggagaatccgcccggatagcttagggtcacgtcaaaactgaccattccgtccacgcatcccagtttatatccccgcatctccatggtcccgtattcctcatggaaaaagtcaatccccagacggtcgcctgtattcctggccccgataaaatactggttcacaaattcaaaaaatggttccagcttttctttatccccaaggatccgcacaacggtccgtcctctctcactgtacaccaccggatacttacaatccggtgtaaacccatatacagggggcttctcctttgtgagataatagttcagatcctcaaagcctgtttcttcgtcacagccaaagatgattctgactgggcgccttaacctaaggcccagcttcttaagggccgccagcccgtaaagacaggccagcacaggccctttattgtccaatactcccctgctgtaaatgaccccgttctccatatatccgctaaagggcggctgtttccatccctcccccaccggcaccacatccacatgcccgatggcgcagacgtatccgtcttctcccctgccatactgggcatagccgatgtagttgtcaagattcaccgtgtcaaaaccaaggcgtccgctgatatccagcgcgcttaaaagagcctgcttcacgcccgggccgaacggggcgtcctctgacccggccccctccacgctgtcaatccgcaccagctcaaggatgctgtcaatcatctcatcctttaaactgtccacggcctctatgatacgctgatctaaacccatatctaaacctatatccgaacccatatcaaagtccctatttaagcccatgaatcattcctcgataggcgccatacgcgtcttcatgtagttttccatccactcctctgaagcaacctcaaaggtacagtgtccgtcctctccccgggttaccagataaaccgtgggttcctggttttccgtgacaactgcgaaggaaaacccttcaatgttggtggcaacgccccattcaccctttgggttcatggctatcagggaaaggtccccggcctggccccttctctccttcagctccgcgtccagcttattcacggctgtctcacatgcctcctggggatgcatgccctcccccatgagtcttacgatttcataggaaatgcaccctttcatcaaatcctcacccagcccggtggcgctggcggcgccgcgcttgctgtccgcataaaaaccggaacctgagataggcgaatcacccacccgtccctttttcttcatgaaaagcccgctggtggatgtggcggcagtcattttacctgtcatgtccaggcatgccatgccaaccgtgtcatgaccggagtaaggtttgatttcctgggcagccacttccttcacccgcttgcggtaatgtgccttggcccggtccgtcagcatgttcttgcgctcaaatccttccttatgtgcaaacttctcagcgccctcggccaccagcaggctgttgaccttttcatggctcaagcgccttgcaatggaaaccgggttggcaaaatccttaatggccgcaacagccccgatatccagcgtatccccgtccatgaacgcggcgtccatctccacttccatctcttcatttggaagtccgccgtatcccacggatttgtagtatggaaaatcctccacctcacggatggctgtctcaatggcatcccccgcgtcctttcctgcctttaaaagctcagaaccctttgtaatcccttccacggccatacgccaggttgcaatcattccccacatggcagattcctcctcatccaatgaattatttaaaacagaatgtattcttaagtccggttatgtcttctccgtcagccagtgccttggccatggtgcacatgttcttaagggcgtcgttcaatcccattccgcccttcttcggggtttccacaatggctaccttatccttgtaggccgcgattgtctccgcattttccacggacatggctgcaaatgcctttgcatcggtggttgcgttgatatcacaggcaacctttgcgcacatggctgcatagtccgcatagttaaaggccggtccgcacatgaccacatccggctgaagcttcttaaccatggcgcagagcttgcggcttacttcctccgggtctgcgagataggtcccgttgccgcagcacaggcatgctgccacgtgcccatccacctgttttaagaagggttccatcatgaccgcgggaccgataggctccttttttcctgtaaggggaaccatggtatcgtcctttgtgccaagtcctgactgaatctggtcatatatcataattatcttcatatcatacacctcttgtttttataacgggcctgcacaaaaggtacaggcccggcatgttaatggagtcacaggtttacttgttacattcatttatcattcatgaaggactgcgtcctacaggtcatcaaaggaaaggtcatcgaagtcgatgtcgtcgtcgtccttgctgtcagcggccttggcttcgtccgccagatactgcttatccatcatcttgatgaatggcatgtagatgaacacgcccaggatcaggagcagcagctggagcacggcgccctgccaccctgttgccaggaaaccggaaagcacgaccggcatggtccatggaatcgcaacgccggaacacaggggaaccaggccgatgctcatgcatacataggaaataacaatgttgatggtgggcaccagcatgaatggaatcaggatcatcgggttcagcacgatgggaaggccgaatacgataggttcattgataccgaacacgcctggaatcaatgccagcttgccaagttccttaatacgtttggaatggcagaataacagcatggcaattaacagtgacaaggtggaaccgcagccgccgaaggtggcaaacaggtcctggaactgctgtgagatgatgtttggcagcgcctggccggcctggaatgcagccaggttgtcggcggacagtgtctgcaggattgggttgaacaccgcgcccacgacggaaccgccatttaccccgaagaaccagaagaagtgcaggaatatataagcgattaccatggccggaagcgtgttgcccagctttaacagcggtgtctgaaggatggtgaagataaaggtaaatgcatccctatatggagtcatggcaaatacgatgttgatcacaaagaacaccagcactgccacgcctgcgggaatcagggctgagaaggatttggatacggtgggcggcacgccgtcaggcatcttgatgacccatccctttttattcacccatgcatagatatgcacggacaggaacgccacgatgataccgacgaagattcccttggaaccaacccatcccagggggatgccggttacggttgtgtcgccggatatgatctcatacggcatgatcaggaaccagcataccatggcgattgcggcgccgaacagtttatccacgtccatctgctctgcaaaggaataaccgatgccgataacggccaggattgccatgatggtgaaggtggcgtctgttggcttggagaagtaggaggtccagttctcaccaaagaaccttgcccagaaattgctccatcccggaatcgggaagttggcaatcagcaggaagaaggaacctacaatcaacagtggcatggataaaaggaaaccgtcacggacagctatcagatacttattcttaccgattttctctgccagcggcatgagtacggactctaacttacttaacattttctattcccccatatcagatatttttattgtgcgccttggcgccggatggtactttatttcgctgacttcatcagcttgatggctgatttgaggactttttcgccgttcatcataccatagtcggtctggtcaattacctgaatcgggatacctgtgctgccgtacttttcaacaatctcagcatagcggtatttaacctggggccctaacaggatgacatccgggtgcttctcatcgatgatctgaccaatcttgccgtccggaaatgcctctacttcgatgggaaggtcatgggagttggcaacaccctgcatcttgcttgccagcatactggttgacatacctgcgctacagaataaatatacacgtttcattataaaatcctccttatgtcctcattctttattatggttgtttttttatttttaatgattatttattttccagcttcttttccagttcaatgatacgctcatagctggcaatcatttcctcggcaatgatcttaaaactttccgcgctcatcagctggtcttccgcgtgtaccaggataagggagccgcctacctcaacgccctgtgcttccttttgaatcagctcaaagtgtgcctcatgcccgactaagaacagcttctgtccttcctcgatgcattttcttgccccgtcaaaatcccctgtctttgctttctggattccttcaatgtagctggaacgcgcagcgcctacattggaaatgatctgaaagcatgtcatctctaatccctctaccataatgctacctcctgtttgctgttttgcttaaaatcgtaaatgagaaaatgcaacaaaaccgtctgtttgctgcatctcttattaagttgcctttattataaggcctttattcagtttttttcattaatcggatttcctagctgttaggaaattcaacccattatcctgtcaataaattcctcataggtgcaggacgacactaattttgccagctcctcaggccggttcaccacattgctgacccagtcaaagaaaatcttaatcatccgctcatccccttcgttgatggcaaagagcatgaccaggcccacatcgaagttcccccagcggaccgggcttttcagctgggccaccgcaatggtggaatggctggcaaaggccccgaaggcatggggaatcgcaaatgcattcacaaaggaggtgggcgacatctgctcccttttaagtacgatatccttgaagtccggctccacgatgccttccttttcaaggccgcggcacagcaggcgtatgatttcctccggcgtcccaagggtcacgttttcatggaaatgctccttgcgtatcaggctgccgatatgggaggtgaattccagctggaactgtttcttgtccagcttattgaccgcctggaggatgcctgactctgtctctgaatccacaaacaggttgattgggaccgtcggcacatccagcttgtgttccaggggaaatgtggtcagtatcagatccgggtccagggaggaaaccgtctcctcctcgaaatagcggaaaatcccaaccacctccaccctctcacggaacatttccgatatcttcttcacacacatatcggaaaatgtctggttatgggggatgatcatgatggtcctgtacttcctgacactgttgatgcgctcgctggcagcgcccagatggagggcaatgtaacaggattccacctcggatatggaagcctccagtttttcctccagaagctccaccacatagatgcccatatcgaacaccagagggtatttgcgcttgatttcctccacgaatacatcctgcatatgggctttggccttgacgcggtctatgaggccgtggatgtgcatcttaagcccggcaatcaggtccccgtcctcccggaaatccagtccgaacagggaatagatcccatccagggcttcggcaaccagctttttcgtgttcagccatttcccttcaaaattcacaaaatcacttgtatagttggaggcccgcttgcccatgatgaccagggcgaacatccccacctcgccgtcatggacctcgatgtggaggcgttttgagatacggtcgaaaaaggtcatggagatctggtattcaatggtatcctcaaggccctgggagccgttatccatattcacataattggcgcagttcatccgctcaatgcttgtgcctgcgtgaaggatgaccatggggaacatggactcgtggatggagtaatcatattcctccagcacatccacaaagatatccttgaccgcaatcaggtcaaagcttttataaaggcccgcaagcaggttcatgttgaggaaattctcctgtacctcagccacaagcaggtccctgtaaaaacgccgtttgctggcctcatccccttttagggaaatacattccctgttgcgtaccagtttcaggttggtgtaaggctccagcatcctgcgtatgcgcttgagatcattgtcaatggaataaccgctgacaaaaatctgatcctgaagagagaccaggttcagctccctggtctcaaacaaaagcttctgtataatgtatatacaccggccccccggggtctgggggacctccggcccaaggttctttttctccggcgcaggaatacttgtcctggcgtcctccataacacgataaccctggcgcacattggattcaatgggcgccggggttatccgtttgttgatagcctccacatcagagcggatggtcctgtctgatactccaaggaggccggccagctgcctgctggtcatccagtcccctctttctgaaagtatggcaagaagctgttcctgtctcacgttctgcatggttagactccttatctcttttgcttatgctttgcagaaggcgaataccttccacggttctacataatttaacagcacatgctcgtactccggcagatgtccgatgacgttcttgcgtccgtcattgggcatatccttaaggacaatgtgcagttcacctttgtacttcaggtacccgtcatttaagattaccacgtccccgcgctttaagtcacgtgtgttggcagcgggaaccggttcatctgcaaaggtaacccttggccatgtggaccggatcatgtactcgctcatatcgccccgtaccacgtgccttggtccataatccaggattttctgctctgtttcagtcagttccttctcaaggaccagcccaaaggtcagtatgcttgggttcacggccgcacaggcctccagctcctcgtcggaagcataggcattggccaccagcacatcatccaccattcctgtggcaaaaaggtggcgcgcctggaagtccatgggcaggccacgatgcatctcaagggtgcagaggccttcgttaaccggccatgggccgtaggttccctggttgttgctggatatgaatgcagccaccggcaggtgcatggacttcatcttcacgttgcatttgttaaaatgctccaggctcaggcccgtatactgctgcggataaaagttatggcaggtaacaagtttggaccggtccgggtgatggtccatgatattctccacatagactaactgtgtgctggcattcagttctatcttaagcccctgtggattataggtcatcaggctttccttcatgccgtcaaagccctcgtccagacggatgccgtccacgtgcatctctttaaaaatggacagatcctcataggaaatccccatcctggaaaatacggccgggcttacatccgggatgatttccatgccgcacccatgggccgtgtctgccagctggcaaaactctcctaccacttcttccctgctcttatcccccacgctcagcaggcaggtaaagacacgcttgtatccaaggcttcctgccttccttatatattcctggtcgcgctgggcagtagaatgctccggataaacggaaatacctaatcttgccataataaatacccctctttcttaataagactgtttcccagtcctgttctatctggtatgctatatataatataaccaattaccagaaaaaagagaggtaaatatatttcctaacagctaggaaatcataaaattgtgcgaagcaggccctgtaggaatccggctgcctgtccctcgtccggtccttccacctgcagttccaggctctcgccctggcgtgcgcccaggctcatgagggacagcacattcttacagtcagctgtctttgttccgcttttcaggtaaatgctgctttcataaccggaagccgcgcggcacaggctcatggcattggttgcatggaggccctgtctgtctgaaataacatatttgtaagtaatcatcttatcatcatcctttgtttttcctcccctcattttaacatagttggggaaagtgcacaagggtttatgggatggggtggaatcaccctacaatgattggaataggatttcttgacaagatgacgggtatgtatgtagaatagaggggttagtatatgcggaattacggaattgtctggaaagaaaacagttggaaggaaaaatgacaggatgaaacttcagagactattaagcctgacgagacaggcgctagataagtatgatttgattgaggacggggacaggattgcagtgggggtgtccggggggaaggacagcctggcgctgctgtatgcgctgcatcatctgcagcggttttatcccaggaagtatgaactgtgtgcggttacggtggatctgggattagggaacatggacctggaaccggtcagggagctgtgcggggagtttggcgtgccctatacggtaatccccactgagattggcaaggttttatttgatatccgcaaagaatccaatccctgctccctctgcgccaagatgcgtaagggcgcgctgaatgaaaaggtaaaggaactgggatgtaataagatagcctatgcccatcacagggatgatgtgattgaaaccatgctgatgtccctgttttatgagggaaggttctattcgttctcaccttatacctatctggaccgcatggacctgacggtcatacgccccttcctgtttgtgacagaggcggatatcgttggattcaagaataaatatcagctgcccgtgtgcaagaatccatgtccaatggacggatataccaagagacagtacattaaggatctgattaaagagcttcagaaggataatccccatctgaaggactgtatgttccatgcaatcctggatgggaatataaagggatggccccaggcggttaagtaacgcctgaggccatttttataatcattcatccctggatcatatcgggatatacggttttatcatactcctggtccggcttcgcctggtccgccggaattgttttctgagcctccaggacctccaggacccgtggttcctgcttccggcggctgtgtggatgtctcttttgacggcggctgggttggcttcacagcaggctttgtatcgtcctgtgcgcctgggccgccttcttccggagcagtggttccttcttccggcttatccggttccttggaaggctttgtcacacccgggcctacctcttctgtttcctctggctccgttgtctctgcctctgtcgtttcaggcgcttttgttgtttcttcctgggtgctctcttccacggttgtttccggcactgtttcaggaggggcggtctggaccggcgcctggcctccgccggacgcaccgccggatgatccgccggaggaacctcccccggaaggagctgccttgccctcctcatataagcctgtttcttctgagatatgggcactgatcttctttacggctgaggatggacggtagcttgtatcctccccatacaggaactggtgaagcatcaccacattgctctccagggtggtggggatgacgcagtccattcttcccaccctcatggtctgtctggagaatgggaacccggccgtgtcgccgatgtggtatttcttaatatcttttaccagcgggattacatcatttaccccaacgctggtggaaatctgcgggatcatataggtgaccagtgaggtcagtgtggctgcatccgcctgttttgctttctcaagcgccagcatgacaacctttctctgacgttccgttctctggaagtccgtatccatgagccggagacggctgtaggccactgcctgtaccccgtccaggtggttggggcctgcctgggccagctggacggaaccgattcccgtggagttgacggtttccgtaataaatgcattgatgtatttaaattcagccggggtaatatcaatatcgataccgcccaggatattgattgcctcagcaacggatttccagttgaaggtggcatagtcgtcaatttttatatccaggttctcttccagggcggcaaccccctgtttctgtccgcctttaaagtatgcctcgttaatcttgtggtaggttccctctgaattgattttcagataggtgtccctgtatacgctgaccagcttgatttcaccggttgaacggtctatgctgcatatcatctgtacgtcagccagtgcattcttcgtattgccgtccctgctatccacgccaaacacagctatgttccatatcccggtaggcctgtggatgaacagccatgccccatatgcgatgaaggccgccagcaatatcaataaaatgctttttaaccctctcttcttccttttttttgccatctgtccctgtccccgccttcctgaggcgttgcggctccttccattgctgtctgcatgaatgtcgtcatattgcctgcgctgccctgtttctgccgtgtacgctgtctggcgtgcagaacctttacccttgtaagcgctgctgcctgaagcggtcctggcagtcttaccggtgcgggaagtatgggcggatgacgggatgcgtccgttgggctgtctgtattcctgttcatcctccaggatgatgcccccggacccatccccgtaaccatactcatccctataaccttccccatccccgtaatcatactcgtccccataaccttccctgttccggtaaccataatcgttcccgtaatcataaccggcctggtcatggcggttctggcggcgttctccgtggctgtaagcatcgcgcccgtattcctcctgcccgaactcctcatcataatagtattcctcatcgtaatggctgcggctgccgtacccctgtttcccattcctgggaggaggtacctgcctgcccgctgccgggctggaagctgaagggccgcgtcttgtccctcttctgttcctggcacgcatacgttccagctcatcatcatcattgtaattcatgacacacacctcatctatctttctcgttatgtttatccggcctactcaaggatgcgccggtagctttgccaatccgatgcagcaatcccaacttccacgttgttcacattgccgctggtttcctggatacacagcatctgtccatctgccgcccatccaaggaagatgaccacatgggcggaggggcctgtgcggatacagatatcgcccggaaccagctgatcctttgtaatggccctgccgctggaaaccagggtacctgtgcttgcagcccccagtcccctgcctgtaacggaccagtatacccagttaatccacccggaacaatccaggcctttcaggaaacgtccgtcctcatcctgcgctgtgacggaaccgaagtcattgcccgtgtaccctggtgaactgggcttacctccccagtagtaaggaattttcccgacagaggaaagggcgtagcggataaaatccttcttctgctggctggtattttcaggaaccatggtcatgtaaatgtctatttcggcagatgtcagtggattgcgcacaaacaggtccgtggtattgataccgtatgtctggtaccagtcctgtccactcagatagcggacctgttccatcgcgggttcatcccagcccttccagttcccctgtcctgctgcgctgccagcctgttggtcatattggaagagtccgttggcttctgtaatcccttttaccgtgatgttgatggaaaagtctatatgaccggggcatggattcaccgggattcctgttccatccgtggtgtccggcacggcttctgcctccgcgctgattgtttcacccggccctttgctgttgtggttggaatctgatgccgaagttgccgcatgatcggtcatctctcctgttttgtcagctgctccggcatcactggccgcctgttctgccccgacgtcctcctctgcttccgatgatgatggggacgattcatcagctgactgttcatggtccgctgcctccccgctttctgaagcagccggaaccatggaggtgtcggattccgccgctacatcagtggatatttcctcatgttccagacagcttccgtcacagtaatagatttcccccatatgtaccgaatagccgtgggaggcttcccacatatctgagacatatgctttcagctgccctgcatcattgaggataccatgataataaaggatgtttgccatggaaacaatgcttttggcattggaagtactgccgcaggcctgtccgtccccgttcaggaactgcaggttcacatttttaaattcaggaatcaccccggaaggggttgtcactgtctcaaccggaagtcctaacagcgctgccagacgttccggtgtatagtgatataaatcatatattccggaggaccacttggcatccagtccggccagctggtcataaagccggccagcataactgtaggagggctgggaagtatcagccccatcctcataaagataagccaggtttaaaatgtccgggctcatcaggacggcattggaaggggtggcatctgaataggatgcggatggcggaaattcaaaatgtggggtaccattcagtgtctccgctgtggaaggtgtgcctatggccgaaggctttggggcaggcggcagactaagctgcccaaaacgcctgcccattgtaaatgacaggaagcagcctgccaggaacacaagggccagggcacatgttttatatatgctttgtttatatgtatgaaatagtttcaggaaattctgtattatatctcgcattgttttataatccttaccgtcacaggtatcatatgcaattacaccgttccccattatatcatacggacaaaagaaaaaatagaacaaaactcttaaagaatcattaattaaagtaccttaataagacaaccatttaatgatatccgctgcatctcacctcaatccttcatccgcatatagattacatagcatataacacgcttcgtacgcttccctgttctcctcttttggattttcaatgcattttcctaaagccagcatatactcttccatggcccacagggaacgcctgatcctgtcctggttatctatccggtttacctttatcaatgccactgctgatatgactgccgccaggactgtggccgcactctttaaaagttcaacatgatccataacatccccctccttatattgtttctatcatacaccgtatttcgacaaaataaaagccgtatttcctcaggaggaggtccaaaaggagcacagattggaataaccatctttaccctggtcccgcataacacccaaaatatggttgacgcataaaatagagtgagatataataatcccaatctatttaggaggaatagggacccatagcaaagctaagcgccatgcaccttttaccgggaccgtgaacagcaggacaaatgctgccggtaagaaggttaacgaggtggagagattatcgagatattcggcgggtactctcccatgccgtccgggcgtgtgatatgctgttaaatatgcgggtaaccgcaaaacagaggcagcataaccggaaaaatttttcaaaaacagaattacggatatgaaagaactgtcctgcggtgacagcttatttttgtgcggccttttttgtgccgcgccatgtatcattcacgtctatgtgacatttacttgtaaactaattgagaaaagaaaggcggaatcatattatgtgtggaatcattggatatacaggaccattagaggccagggacctgcttttaaacggtctggcagggctggaatacagaggctatgacagcgccgggattgcttattttaatacggcatcccaggtcaggatcattaagaacgtgggcaaggtggctgccctcagggaatgtgtcaaaaagaccgcggaggtgtcacattgcggcatcggccacacgcgctgggcaacccacggcggtgtgacggataagaatgcccatccccacagggctggccaggtaaccctgatccataacggtatcatagagaattaccaccagcttacagaagaatatggacttggggataaactggtatcccagaccgacagcgaggtggctgcctgggttctggacgcggtgtacagggactgccgccacgacccgttagctgccatcggggcatttgtaaagaaactggctggttcttacggcttctgcatcctttttgatgaccggccaggggaaatatatgcagtccgcaatgtaagcccgctggtggccgcctacacccgttccggggccatcattgcctccgacctgacagcgcttatctcctacacaaaggaatattttgtagtgcccgagggacatattgtccgtctgaccccttataaggtaagggtatatgacatggattacaaccggattgagccggaaatgctggaggtcagctggaacatggacgcggccatgaagaacggcttcccccatttcatgctgaaggaaatccatgaacagccggaggccctgaggaacaccatccttccacgcttggcagggaacctgccggactttaccgcggacggcattccggatgagctgttcctggattgtaaccagatacgcatcattgcgtgcggaacagccatgcacgccgggattgtggctaaggcgctgatggaaccccttctgaggattccggtcacggtgtccattgcatcggaattccggtatgaggaccctctggtggacgggaaaaccttggcaatcgtcatttcccagtccggcgaaaccattgatacgctggctgccatgcggctggcacagtcccttggggcgcctgtactgtcaattgtcaatgtgaaaggctccaccattgccagggaaagtgatcatgtattttatacccacgccggtccggagatagcggttgccagcacaaaagcctactctgtccagctggccgccctctacatgctctgctgccgcatggcccttaccaggggacgctgcaccaaagctcaggccgggcagttcatggaggaccttctggcggtgattccggccatggaggcaatgattggccagtcggaccatatcagatcctttgtacgccacctgatccgtgaaagggacaccttcttcatcggaaggggcctggattatgccttttccctggaaggcgcactgaagctgaaggaaatatcctatatccatgccgaggcttatgctgccggtgaattaaaacacgggaccattgccctgatttatgacaatgtgcctgtcatcgcaatcgccacccaggaccacgtgtttgccaagaccatttccaatgtcagggaagtgaaggcaaggggggcttacgtaatccttctcgcaaaggagcaggcccagctggaggacggcgttgcggatatggagctgcggataccggatctggaggaccggttcaccgtattccccattgccgtggcccttcagctcattgcctactatgcatccatcggcaagaacctggatgtggaccagccaaggaacctggccaaatcagttaccgtggaatgattccattggggcgctatcccgccccaatcctctctttttcagatccatgctgcctttagatgtggcttagagaatcatctgctatagttacaatcacaggaaatgattcaactattaataaaggagagttaaacatgaaaaagagaatcgctttatttttacttacaggtgcctgcctgatgaatacggtgccctgctttgcatcccagtccgtcaaggtcagttatgtgggttcccagggaacagaatactcaacgctgccggacagcgggaccctgcaaagagacgcgggattcaagccaaaggctccggccgcactggcgggaggctatcagtttgacagcggaaggattacggaatcatttgatatggacgcagacggcgctcaggtcaacaggcagaaaggcatcaacttccaatatgtgaaacaatccggcagcactgccaaaacggtcaccctgtccgcggaaccggcatccggccagtccttttcaaaagattccacccttgtggaatatggggaaatgaatctgtattacactacggaccaggccaactccatatcctggatggacggggatgtttactatatgcttatggacatcaaaaagtctgtctcaaaagatgagctgacggcaatggcaaaacaaatgattgacatggacacaacttctgcccaataagggtacatcatcctgccatcaaaaagatgctgccgcaccaaactggattggtacggcagcatccgctgttttcatatctgatattacttctgtttgttccacgcctgtttcacttttgcaaaattcatgattacgtccactgcgccgtctgcccccaccttgctgctgttaatgcataaatcatagctgcgcgggtcgctccactttttgttggaataataattatagtagttggagcgctgcttgtcggttttaatcatgatatcctttgccttggattcgtccaccttgtaaagctcctgaagacgtttcagcttatccttgtcatctcctgtgatgaatacgcttaccacattgggataatcctccagtgcgtaatccgcgcagcgtccgacgataacgcaggaagcctcgtctgccagtttcttgatggtatcaaactgtgccaggaatatcttgtggttaatgggcatatcggaatatccggatgcggtatatcccatggaataggaatccattaccagggaatacaggaagctgctggtgggtcgttcatcgtgtttctcaaacaattcctcgcagaggccgctgtgcttggctgccatggctaacaattccttgtcatagcacttgacccccatcttctcagccagcatctcgcctattaattttcctccgcttccacactgtctgccaattgtgataataagattatttgtcattccacattcccctttctgcactctatgtcatgttatgaatgagtcatattttatctattaagtattataactcaaaaattcagaaaagtatatagaaatgcgcaataaaatataaaataacccaaagcttttcgacaaaagtgacaacttgtctgctactgtctctcttaatgagcattttatctcaaaaagtattttatctcaaattccttaaaagcctttcaaaatactcgggcaaaggcgcggtgaactccatatattcccctgtcctgggatggacgatcccaaggacgcctgcgtgaagggtctgtcccgtaaggcctggcaccgggcacttggcagggccgtacaccttgtctcctaaaaggggatgatggaggctggccatgtgcacgcggatctggtgggtcctgccggtttccaggcggcattccacgtaggtatattgttcaaaccgccttaacacctggtagtgggtgacggcgttcctgccgttgttataattgatgcacattttcttgcgctctgtctgatggcgtccgatgggcgcgtccactgtcccctcatcttcttttatgaccccgtggacaatggcctggtatcgccgggtgatggaatgctcctttaactgggcggcaatggagttgtgtgccatatcattcttgcacacaatgagcacgcctgttgtgtccatatcaatcctgtgtacgatgcctggacgcatgaccccgttgatgccggacagctggtccttgcagtgatacatcaggccgttgaccagggtatggctgtaatgccctgccgcaggatggacaaccatcccctttggcttattgaccagtatgatgtcctggtcctcataaaggatgtccagatccatgggttccgcctcaatctcaggctccactgcctccggcacatccacctcaatatggtcatccgcggtaaccacatagctggcctttataagcctgccgttaaccagaacctgccctgatttaaggagcttctggatataggagcggcttaattcggggcaggtttcggcaaggtatctgtcaatacgcacatcggactccaggtccgtgggataaaattcttgtttcaagggtattactccttcttttttaatgcaaagcaggccatatcctcatccttgtaataaaacatgatgagaagcacaagacatgcggcagcaatggtcacataacagtccgcaacattgaatatgggaaaattaatcagcttaaaatacaggaaatccaccacatatccctgggtcacccggtcaatcatattgccgacagcgcctgcactgaccatcatcaggcatacggacaggggacggtacctcctgtctgtgggcatcctgagcataaggtaagccacagcccccagcactgccagtgcaatcaggaaaaagaacagctgcttttcctgcatcatgccaaaggcagcgccgcggttctcggaataaaagaattcaaatacaccatcccagataacatacggtttactgcctttcagatgggctactaccagccccttggtccactggtccagccccaccaggatgatgaatccgatgacaaagctggcgagcatggattttttctgtttcgtcattccctgtgtcctcctattatgtcaaatccagccttcatctcattgccggtaacgcttttgtccacgaaagcctctcctatggccttaagaaggatgaacttaatgacaccggcatccattttcttatcactttttgctgtcaggcttacgtcttcccagttaaggccgtccacatggacaggaaggccgaatccggcaaacacatcccttaacgcaaggaactcttcctctgtaatcattccccttatatgggaaatatatcccgccgcaatacagccaagccccacgcaatgaccgtgaagcatggtgaaatccttcagtttttcaactgcatggcccagggtatggccaaagtttaaaagggcccgctccccctgctccgtgggatccttttcaaccacatcctttttaatccggttacttccatataccatggcctggcacaggtcaaggtcgcgttttaatatcccttcacggttatccaccagccactggtagtaatccttatccttaataagcccatgcttgatgacctcccccattccggaagagaactgctccttgggcagcgaaagcagggtacttaagttggtgtatacaaaaagcggcatgtggaatgcgcctaccatgttcttataggcgtcaaaatccacaccggtcttgcctccgatgctggaatccacctgggataaaagggtggtgggaatctggaaaaaaccaatgcccctaagataagtagctgctgcaaagccgcacagatcgcctacaacgccgccgccaagggctgccagtacgtccttccggtcaaaatgttccaggatcaggtgttcatacagtttctttaccgtatccaggttcttgttctcttctcctgccgggaatgtgaaaacagaaacctgcctgcagcagccggacaggatggttttcacttcctccagataaagaggcgccacattggaatctgtcacaatgcatattttatgtccttctaatgaaagacggtcagcctcttcctttaagccggaaaaggaggtatccatcacaatgtcataaatcggttttccatccctgcacacgttcattctgtccgccatatcagtttcctcctaaaagcctgtctgcgccgccctctggcagcgtgcaggacaacataaaatcggcagactcccatggtctgccgcgttcacgtccatatcgtcttcttatcctatcttataaacggatattaagtcctgacacgtccatacccatggcgccgccggcagccaggatatcctggaaatctccggataactcaacggaatcaggggttgcaataaagatataattggatatcttctgcaggttgccgttcatggaataggttgccccggaagtgaaatcaattatcctctgagctacctctgtatgtataccctccatattaagtaccactgccttgccggccaggagataatcacatatatccctggagtcttccattgaggtcggcttaatcattgtgacctccatgctgcgtctcataggcactactttgggattggatcttcctaaaaatcgtggcttgtccggttcctcttcgtcatcatattccgtactcttctttgtaaacagccccttgcgaggagcttcctcttcaaagtcatcgtccaggtagtaatcatcctcttcctcttcaggacttaatctcatggtatccattaacttacctaacagactcattttacactctccaatctctatatgaagtgtctacaggacatatggctggtttgcgtatcaaaacagcatgtcctggccaaacaccttatcgtacaccaaaaatcccggtgccgaccctaaccatggtggcgccttcctcaacagcgacttcataatccccagtcattcccattgagagcacatccatagtaacattatcaatgtttttcttatctatgtcaacagcaaattcaaataattttttaaaaattccgcgattttcttctggattctctacaaatggcgcaattgtcataaggcccttgatatgaacatggggaaaatccttaattgtcataattgcatcttctacttcttccagcatgaagccatatttgctttcttcccttgcaacattgacttccagaaggatatccacgtccagacctgctttggctgcatcggtttcaatctgctgtgccagccgcagggaatccacggagtgaatcagcactgccttcccaaggacctggctcaccttgttgcgctgcagatggccgatcatatgccagcgtatatcctcaggaagttccggcttcttggccacgatttcctgtactttgttttcaccgaaatccctggctcctgcggcatatgcttcctccagcatgggcacgggcttggtcttgctgacagcaatcagcgtgaccgcctttgggtccctgcctgaccggatgcaggcctgttcaatccgtctgtttacttcgattaaatgttcttttatcataatcctatccctccgtgtaaagttcagtcttattattggtataacagctgcccctcttccaccatggaagcatccagcacaatatggtcataaacagaaaggccataggttgaattgcggcgcaccgtataaaattcattgttggaatccagtatctcaatccgtttaaaaacagtgtatcccttattgatattataaacgccttttaaggatgcggtacgtccgatctggtaacggtccggtgagtcgggtttcacaatatagtcccctgccttgaagccattttcctcacccatgtccacgtaatagaattcctcgtcagaagaatatatatccgcagggacaaataccaccgaaggcccgttttccgtgtaaacctccttattgaaaccattttccgaggtatccccgccctgggtgagatactccagcggcaccaggtaaaagcttttttccgtcacagcgctgaccggtatctttaacccgtcagactgctccgtcacaatctcgaaattgatgaaacggtctgatatgaactgttccatatattttgtgaaatccagcctgccataggtggcgccgtcctttccggtaaaggtggaataggcggccggcgtgttcatggaataatcgctgaacacgaccctcagcctgtccttgcccgcatacaggcctgcatcctcctcggtcagggggaatacgatggaccagttctccgaggttacgatcttgtaggccggcatgccgctgtcaatcaggtcaccggactttttaagtgtcttgctgtacgtttcccggttaaagctttcggcttcaatatcagccgtggtcatgtcctcgtaggagtcaaatccataggagaccacacctgatacatccgtgcgcacctgctcaaagacagcgcctgattcctgggccagcttgtctaactggtccagagcgctgaaactggaatactccatcaccgctgcctccagggaatatcttgcatcataaatggaggaaaagtcctggtccttaaatgaaagcacaaaggatgtaagctgttttttcaggtcggacaggctctcatccgtaagtccgttaccgtcctcggctttatcttttaataactcctccagattacctgtctcatccagggaatatatcctgcttcccacggaggcccgttttccttccctcagataatagttaatatatcctgaacggtccgctgtctttacctgctcttccctgaggatcagaccgttatatgtcctgttgttaacaattcctccgtctaccacttcatagaattgtatcttctcccttttcaaatatgtatatacactgaatatcagatagaggaaaatgattgcaaagataatcatacccacattgatattaagcggccgcctgtagcggacaaccttcttgttcttttttttagccatggaacaaggcctctccttttactgaaatggaacgataaaccggcagatcttcctgcaggtccaaatagcagccaacaaataactgcccgccgcgccaggcatccaaatcccggcacggcaggcagccctatcactcctgtcacctatcttatcacaaaaaatgtatcattacaatgaaataatcacatcgcccttcgcgcagtccggaagctcggcggcatccatggaaatactcaggacaaaggttacatgatacttttcaccgatatttttcaatgtcatatatgtatcggaaatctcttcgccttccaggcatgacagctttaaaaagctatccaggtacattgtctccagatcgtgatcctgggaaatgataccacagataaatcctaaaaatccttcactgcttttaattgggaattcattgacattaatgagacggatcttattatttaactcatacatatgctgggcactcttatccagatatacgacagtgccgttggcccccttgattgctgcattggccatatctaacagatgtttggtcttgcccttacccttttttcccgcaataatctgaaccatatgaatctcctccttgagttatatatgttgtataaaaaatcaattaagattactctaattatagtataacttcatagaaagcgcaatcactatttgacgattttagaaattatatttgtcatattgtcatagagatggggacggctgtctgccttcaatacaaccgatatatactccttatcagagtcatccctggaagccatgatcagacaatagcccgccgccttggtggtgcctgtcttgcctccgaatacctttaagccatccggggtctccctttcccctgtcatgaaccagttgctgcccttccaggtctttgacaccggttcactgtttttgttgtggtaattggcagtgtacgccgttgtccccacaatctggcggaatacaggatacttaagggcctcattgaatataaggtataagtcataagccgtggtataatggtccggatcattcaaaccatgaggattcacaaaatgggtgccggtagcgcccagtctgagggcctcttcgttcatcatatccgcaaacgcgtcaacactgcctgctatatggactgcgatggcagcccccgcatcattgcccgaaggaagcatgagaccataaagaagctgctccagtgtcagagtgtctcctggttcaatgccgcacagcgttgcgcccggttccgtgatgacagcatcatccgtcacaaggacacgggacttaaggtccccttccctgatggctaccagggcagtcattatctttgtgatgctggccggatacatacgctcaaacgcatccttgctgtaaaggacttccctgtcatccaagtcaaaaagcgctgctgcttccgatgtggcaaaaccagggtcaaatgaagcctcatccgtgacaacgcacagatcagaggcaaaggcatctgaaaaacgtgtggttgcggcctcctcttccagcgccggaatccgctccgcggcaacataggcatccttaagaccgccggaacagccggtcagccccatggacgctgcgattaaaagtgcacacaaaagggcagatgcccgtttcatgcccttcactctgcccctgacagccattatctggcaacctcccgccattccatatcgcctctgtccagagccttgattaaaagctctgcagaagccagattggtggcaagcggtatattatagatatcacacagacggaccacattgttcacatccggctcatgtggcttgggattgttgggatcccttaagaagatgaccagatccatctcattgtgctcaatctgggcagccatctgctgcattccgccaagatggccggccagatacttgtggatgttcaggttggcaacctcctcaatcaggcgtcccgttgtccctgtagcatacagggtattcttgctcaggattcccctgtatgcgatgcagaagttctgcatcagctttttctttgcgtcatgtgcaatcaaaccaattgtcatattatataaccctccttggattagaaatgtcttgtctctctttgaagtcctacgttcagcaccagccccatcccaatgaaaatactgatcagggaactgcttccgaaactgatgaaaggaagcggaagacccgtgttggggaaaatacccgtggcaaccgcgatattggcaaaagactggaacgctaccagggtagccatgccaacacacaggagcctgccggacagatccctggcccgggcagccatcataagacattcatatactatcagtaaaaacagggcaatcaccaccacacagccgataaaccccaactcctcgccaataacggcaaagatgaaatcggtctgctcctcggataggaaattaccgttttttacagaagcaatcgtagtgttgaacaaccccttgccctttaactggccggagccaatggctatgatggagttattctgctggtagcgggcctctccgtactgttccggataaaaccatgccaggatacggcctgcctggtattccttgataaaaggaatcataccatggagcagcaggtagacgaatgtggtaacgaccggtattgtaacagccagggtacccatgatccatctgtaactgatgccgctggcaaacacgattccaaggaccattaccatgatgacgagacaggtggacagattcggctgctcaaatatcagggcggccggagctgcgaacagggcagctgcaattgctaccgtgctgacctgattgattctttcctgatacttcatgaaataccaggaaaaagtcacaatcaggccaatctttacaaattcggacggctgaagctgtccgattaccggcacctcaatccagcgtttcgcattattgaccacattcccccatatcagcacggccaccagactggcgatacatacgccgtatatgaccatgctgaagttaaggatcctgtgataatcaataagtgacaaccctatcgccactgcgagtccaactaaaacacccaagagctgtttgttgactgcatccgcattcatgttggtggcgcttctgatgaccagtacaccgatgatgttgagtgcaatcatataaaaaaccagccggaagttaaaatgtctaaaatcataatccaaaaacatttaatatagccccttgttcgatatggaacgaatcggtatgttggcatgaagcacaggcagggcccggctgttgccggataaaggactgtctgtttccatctgtatctggaccttgtccttttctatctccatgtattttgaaatggcatgaatcatgtcatcccttatcatcagtatcatctccggtgagcagcctgccttgtcggataccagcaaaagtttaagccgcatcttagctgtctctccggaacgccgggtatgaaaccttaaaaaccatctcaccttgacaccatcccttctaagcacgccgtaatatgctgcgcagcctggcgaacagagtctcagactgtccgggattagccatgggaacactctcccctaacagcctccggcagatgtccaggtaagcctgtccagccggggaacccatacccactaacggttcaccctggttggtagatacgacgatgtactcgtcatcggggactgctccgataatgtttactgccagaatgtccgtgacgtcgctgagggacatcatgtctcccctgcgcaccatgtcggcccggatacggttaacgataaggtccacctcgtcaatctccgcatgttccagaagcccgatgatacggtccgcgtcccggatggccgaaacctcaggtgtggtaaccaccaaggcacggtctgccccggcaatggcattgtaaaatccctgttcaatgcctgcagggcaatccagcagtatgtagtcaaattcttcccgtaaatccgctaccagcttcaccatctgttccggattcacggcagtcttgtcccgcgtctgtgcagacggcagtaaataaaggttcggatatcttttgtctcttatcagggcctgcttcatacggcagttgccttccaccacgtccacaagattgtagacaatgcggttctccagtcccatgaccacatccaggttgcgcaggccgatatccgtatcaatcagcactacacgtttacccagtatagccagtcctgttcccacattggcagaagtagtcgttttgcctaccccgccttttccagaagtaaccacaatgacctcactcataatgaaatcctcctgaaaaatactttaccttcctattgtacattaaatttcgtaaatttaccagtatttttttggcattaagcaaaatttaacatattgtttaggaatgtttttttgagcgggcgaacctggatttctccatcctccacaaaagcaagcatgggaccacgtcccagacgcttgttccgctcattgaaccggctgctcctgctgccgatccggatctgcagcggggccatctcaaaggccatgatgaccgcatccatgttgccggcaacgccggctgtcacggtccccttaaggtcccccagtatgatgacattgcctttggccgtcaccctggccccatgctccacatcccctatgatgatgatactggcctccgactccaggcagtccccccgccggagcgtcccgcggtaaaactgccctgtctgggagcttagttccatcagcttatcattcagtgctttttcacagcgctcaatccgctctgcatccgtgtcaaggagacagaggatctcaatctgtgagttcctcgtaatcgtatcaacaatctcgaattcctcggctgcagtaaggctccgtccttccaaggtaagggtcatctgtacggatccccagaacctggcgctttcactgaacttcttggcaatggcctccaggagttcttcaaagggaagcccagggtccaggattacggtcattcccgctttactgcttttgattactaccgcattgtgcatacaatcacctcttttgctggtttaatcaccaatagttacatttgatacacctaaggcgccggaacccatgatctgctccagtgtcgtatatccataataatactcatatacctttttgccaagggtagccgcgttagtacccgcataaccgtaaggtatgttcacggtaacggcaacctccggatggctgtagggcgcaaaggatatgaaaaaggcatggttggcacggttcctgttctcctgtgccgtacctgtcttgcctgccacttccaccggcaggtctgagaaaatctttttggccgagctgtctgtaatcacacggcgcataccggtctgcaccgcattccatgtggtgtcggccgcttcgatatgggaactggctgcaggcgagtaatcggttatcagattgccgtccgagtcagtaagtttgtctaaaaggctcagttcgaatacggttccccggttggcaagggccgccacgtagcgggaaagctgtacattggtataggaatgggtaccctgtcccatggcggaacgctccgggtcctccgatgaaatctggggatcgttttcaggaatctccacccctgaggtgtggtccagtccaaacatggccgcatatttgcgaagggtggtaagaccctggtccggtgaataggtaccgtcaggcttgatgcacagcctgtgggccagttccgcaaaaaagtagttacaggaattctgtatgccttcctctatgttctcggcgttatggcgtccgggccatatccagcacttaatcggattggatacctggtcatagataccggtacattcaatggtatccgtaaggccgattaccccctcttccagcgctgccacggcagtgattggcttaaaggtggaaccaggcgcttttaatgcctgggtggcattgttgtataacggtcttgaaaggtcatcctgaagctgggcaaagtaggccgcgtccacgcttccggacatctggttattatcatagcttggataggtcacaagggctcttacctcgcctgtgcggatatctgtcaccaccacgcctgccgtacatggatccagggccagctgcgcaggtgtcagttccaggttggatatcttttcacggatgaactggaacgcataagcgctgcctcctgtcctgagggcggcaatctcctggggattatcatccaggaccccctgggcaaacagggccaggcacagctggttcccggtaatgacctcgtcattcaccagatagcggaacatacgcttggtaaacttattgtcattcttaagggattctatcacataatccaccagctgtccgaatatatcatccgcatccgaatacttactggacacatccagccgtgtggtatccacccagttgcccgcaatcccgctgtaaatgtaatccctcaggctgatggtaccgtcccgccatgcctggtactggggggaggactggtcaatcttatccttctggatgataccaatggatgattctgataaaaagctatagatataattcatataggtagacatatcatccggcaggtcgttcatggccatggcatgtccgctcataagttcgttgcggatggaattaaggatctgttccctggaggccatataggtgccgtatatctccttttcaatgtccgaggcatcctccctggccatgtccgccagggacaggacattgttgttgatcagctggtaataggcgtccttgaccggaatcgggattttggaggagtcataggtcttatcgggatccaggtcgtctatctgaaggttatagcttatgatgccggccagctgctgttctatcagcttatatatggcaatctgcaggtcatggtcaatggtaaggtacacatcatcccctgccctggcatccgtcttttcaatgatttcacggggacgccccatattatccacatacatcctggaatggcccttttcaccctgaagctccagctccatggacttctcaatgccggtgcggcccacgatgtcgttcaggtcatatttcctggcatcctcgggaaggcctgcggcttcttctgtatcacgccactggtcattgagttcgtccagctggtcctcctggaccttgcccgtatagccgatgatgggggcaaaatacagactgtccgcatattcccggatataggactgttccacggacacacccttcagataggccaggttctcgttgatttcagtcatggtcacatcgctgacattggaggacaccgtagtggtttcatacttctggtattcggtcagcttcatggtgaagatgatattgaccatgtcaagggcaatgttatccggaagtacaaggggattccccttgtcatccttcatctcatccagcttatagctgtgctttttgatttcaaatgcctccctggccgtgatgttggttgggtatctgcccttggggtcatccagttcactggaggaggaacggccgtaaaagttcaggaaaaaccttgtccttgccgcgtccgaggtaaaggtgtagaacatttccccattctggtccatggctatctcaagcttgccttccaccttctcaccgcgccgctccaggatggtgaccagcctgtggagcatctggttgcggtcggctgtcttggggtaatccccggtatcctggattaccacggaataagccagtttattgtaggccagttcaaaaccgttgcagtcatatatcttgcccctggttcccggcgtgtccacgctgcgctctgtcttctgcatgtacttttcctgataatcactgccgtccaggatctgcatgcggaacagcttgcccacaaggcccgcgaacatcagggtaaacatgacagaaagggcaaaaagccgggaactgaacagttttttgaaaaattctcgtactatctctaaaagctcatcaaacaaggttcttgtctctccttttccctatatcctccacacgtctgctggcggataagaacagccggtaaatcagaagggttgtcactgccgtaaaaatgatttccggtaggatgatattcctgaaatagtatggaaggttcagccttccacggatcaggaaccggaatacatagacatacaggctgtaccacaatccgttgacaatgctcaggatcaggggcagcgtgatgtagtcctcatagtaatatttggtgaatatgccgttgacatatccgatgtatacataaatcagggtataaaacccaaagggtccgctgtagaacaggtccagcagcagcccggataaaatcccataaagcatccccgcattcttcccatggatgaatccgaaggagaacgtaaggattaaaagcagattgggcgttgctgacaggaagggcagtaaagggaatacgcagttctgcaccgtaaatgccagtacgatgaacaatatattgataagaacctgttttacctttgcttgaatcactgggcagccgcctctcctgtatctttgatatccgtgatgatgagtacctcctgcaggttatcaaaatccgcaatgggtatcaggtacccggattgggtcagatggtccgggtcaatggtcacatccgacgcatacccgattaaaatgccgggcaggaacttggtgctgatgttggaggtgacaatctggtcaccgtcccgtatctgggcatcctttgaaaaatcagtaagcttaagccttccctcctcatagagggtcaggtcccctgccacgatgcaggtgtaggaagaatccagcttcatggcgcctacacggttggagtcatcgatgatggagcggaccgttgcatagttggcgcccacatcggtcacgattcccaccaggcccccgtcggccaccacgttcatgtccacagccaccccgtccgcggagcctttgttgatccggaatacctggaaccacttttcagagtccctggcaatgacacgggccccaatcttgttgtactgcatatattcctggtccagctcatacaactgtctgagacggtccagttcaaactgttcggcctggagacggttattatcctcggtcagctgggcaatctggtctttcagctcctcgttctgggcaagggcatccttcagggtgccgtaatttttcatctcgttgtagataccggtacccaccgcgttgaccccggactggattggaataaggaaatatcccactccggtgcgcagcggatccatgacaccgtctttcagggaggtgatgcagattaacagtacgcacagtaccgtaaggcctgtaagtatatatttgctgtgtttagattccatggattgacttcctcttacaatattttctgttcacggaaactgagataccgtctgtctccgatgatgatatggtcgatgagggtgatgccgataagcacgcccgcttcctttacacgttccgtgagcataaggtctgcacggctggggctggggtcaccgctggggtggttgtgcaccagcaccatggatacggcgcagcacctgagggcctctatcagtatctccctgggcgtcatcacggaagcattgaccgttcctctggatatgagcagatcctttatcagtccctgctttgtattcaggaacatgacccgtatctcctcctgctccagatgacgcatatcttccatataatagtcagatatctggctgggatgttcaaaggaaatgcggttgatgcctgtctgcttcttccagatgcgccgggacagctcaccgatgcaaaggagctgtacacctttcaccttacccacccctttgattttcatgaaatcattcagggaatggtgtaaaagccccagcagaccgtcacccgggctgccaagggccagaagctttcctgccaggtccagggaggaatgatccctgctgcctgtacgtatgatgaccgccagaagttccgcgtccgtcaggacgcccggaccaaaacagagacacttctcataagggcggtccacacttggtaaatccttcattcttattctttccatctctctcctaactacgcacctctccaagcacaaagttaagaaaatcaggaaatcagataaaccggtaaataatcagggcaatggccactccgatgatactggccatggtgattttaatcgtaagcccaaaggtgatgaccaggataccgaaattaatgacaagaggcgaatccagtccaaaggattgtccaaaattcagccagccaagccatgaaatcccctcagccatctgtcccatgaagccgcccaggacaatacctgccagcagcatgattaaaagtatccagaaattcctgtaatgcatatgccttgtcctccggtcccaccagcaggacagcagagtgtacgcactcccctgccggattagtatatattaccataagttatctgaggtgtcatcttaaaattttcgtaacaatccagactgcgcgaaaatcagcacacatcccttcaggatgacgccctacggacagttatggatattcacgacaccgtcatccaaaagctgctgcaaagacttaaggattccaagctttgcatggtaccaggtaagcccgccctggaaataaacagcatacggcggcttaatcggcccgtccgcagacagttcaatggatgatccctgtacaaaagcccctgccgccatgatgaccgggctgtcatatcccggcatgtcccaaggctccggcgtcacgaagctgtccacaggcgcagccgcctgaatccccttacagaacgcaatcacgccctcaggcgtgccaaaggtaatggcctgtatgatatcatggcgtgactcccttccatcgggaacaaccccaaagcccagccgttcataaacattcgccgcaaaaatagcccccttcaacgctccagccacaaccgtcggtgaaaggaacagcccctgataaagctgctggttaatccccaggctggcccccacctccttgccaaggcccggcgcgctaagccggtaggaagccttatccacgcactccttcttccccacaatatacccgccgatgggagccaggccgccgcccggattcttaatcagcgatcccacaatcatatccgcgccaacatccgtaggctccagcttctccacaaactcgccgtagcagttatccaccatacagataacctccggcttcctgctcttaataaaagcaatcagctccccaatccgttccaccgaaagggtaggccgtgtagcataccctttggaccgctggattgtaaccagcctggtcctctcattcagcgccttctcaatcccctcaaaatcaaatcccccgtcctcaagcaggtccacctgcctgtaagtcaccccatactccttaagtgacccaacggaatcccggattccaatgacttcctccaatgtatcataaggcttccccacaggggaaagcagttcatcccccggcctgaggttccccgacaacgccacatgcagcgcatgtgtcccgctaatcagctgcggcctcacaagggcgctctccccgtgaaacacgctggcatacacatcctccagcgtatcccttcccagatcattatatccataccctgtagtagcggcaaaatgtatatcactgaccctgttaacctgcatcccccgtataaccttcatctgattatactccgcaaccgcatcaatccccgcaaaccgttcccgaagcccctcttctatctcagcgccaaaccccagcacctcatccccaatccccaattccctatacatatcctttaactcaatattctccatatcccttccgtatctccattcccattcatctacttaataacacaaacctaacatcccaaacacaaactataaatctaatatctatataatccttaatatgattactaacaaaacaccatgattaacaaaatatcattccccaacatcctaatcactatatcccagacataaaccacccatatcaaaccatatatctcccacccaaatcagggcatgcagatggaggaactaaatctgcaaacaggccccggtactgccttatgcaattaacgttgaaaacagcacccattaattacgcaaggcagaaccaggcccttcacgacacatccatttccccttgcgaatgcccagcgccggatggtccatacaccctgtgaagaccatttttgtacgccggcacttaggcgcggtccctcacgcgccttagtaccgctgcgtacaaaaccgagcgcgagcgtgtctgaacagggtgtatggaccatccggtgcggaccttcgccgactcactattgtagcacaatccccgccccaacgcaatcctctattatccgttccacaaccaacgctgcatcattcccaaaatcaggcaggttcagccagcgcacatcccgttcccgtttaaaccaggtcagctgccgcttggcaaaatgccgggtatcccgtttgaggatatagaccgcctcatccagggtgcatctgccatccaggtaatccaggatttccttatatccaaggccctgcatggaggtctgtccacgatggcagcccattgcctttaaggcctgcacttcctccaccaggccgttttcaatcatctggtccacgcgccggtcaatccgtccatagaggacagggcgctgcgtgttcaccacgtaatataggaaattatatggggattcctttacccgctcttcctgattatggaccgatatcctctcacctgtcaggcggtaatattcaatggcgcggatgaccctttttacattattggcatggatccgtgcagcggattccgggtcgatttcctccagcatggcatgcagcacagcaggagcagcctcaccttccctggcagccagttcctccagttcccggcgcacaaggctctcatcgtcattctccttaaaatcaatgtcatagagaagggcctgtatatagaagccggtacctcctgcaatgatagggatgcggtgatggctgtaaatctcctccagcgcctcctttgccatatgctggaatgtgacaacattaaaatcctgatccggttccagcacatcgatgagatgatgggggactccctccatctcatgggccgtaatcttggccgaaccgatatccatgtgccggtatacctgcatggaatcggcgctgatgatttcacctcctatggccttggccagtttgatggacaaggatgtttttccgacggctgtcgggccggtcagtacaataagcggctgcttcatatgcgggctgctcctttcagtcatatcttggtcgttcctattgggtcatgtccaggtcatgtcttggtcatgtctaaaccatgccttacacaatccgtttgaatttcttttccaattcatatttgctcatggaaatgatggtgggccggccatgggggcaggcatatgggttgtccagccccagcagctggtcaatcagttcattggcctccgagaaggacatggaatgatggcccttaaccgctgccttacaggacatggaagccaccttctcataaatgatatccgggttatgtaccgacatatcatcggacagcccgtctaacatctcaatgagcaggtccttcttggcaatggaaaacaggtttgcaggaaccccgcgcaccgcatattccctgccgccaaaaggctctatctcgaatcccattccggtaaagtattccatgtatttatttaacagcagttcctcgttcatattcagggtaaggatgatgggaggttctaccatctgtgtgtcatactgccgtgtcttcagggttttgatggtcttttcatatagtactttttcatgtgcggcatgctggtcaatgatgaacagctgctcattgtactccaccatccagtatgtatcaaacagctgtccgatgagtttgtgcttcagacgggctttggggtccagcagtttaccgtcaaagaaatccaactgctgaggattttcctctatcatctcaggagtacctaaaggcgagtctgtatcggaagtggaggaaattcctcttttaatcgccctggaaggaatatcggtggaggaaaattctccagaaacacaggaatctgttgccgtcgtggggcttggaccggttatttccttctgttcattttcgatggaacttcccaatccggctggtctttctgaggtggttggccttccaagtccagccggactttccgtcatcaccgcagccccggttccctcttctgtggatattcctccatgttccggctggctgccagcctgtccagtcccagcctttgcagcggcttctgcctgttcccgccttctctccttcagccagtccggcatcaggtcatttacataggacggttttggcggcggggtctggctgtaggatactgcctggctgccggattgtggtgtcgatggtacgccccccggtgccgcggcttgggatggcctggctcccagcgccatggcctccggtgctgcggactgggatggcctggctcccaagggcctgtcccccgtcgctgcattttgcaggggcctgtcccctggcgccatggcctggcgcctgcgcacttcgaagggttccggtctgggggccagacgttccgccagtttggcggcctctttttcccttttttcagtcaggcttacctcgggaatcagttccttatgcgcaagggcatcgcccaccgcctttaccaccgatttatatacgctttccccgtcgctgaaacgcagttccatcttggtgggatggacattcacgtccagggtatccggctgtatggtaaaatgcagcatggtgaacgggtatttgtgctgcatcatgaatggcttgtacgcctcttctatggcctttgatatgatgttgctccttatataacgcccgttgatgaaataattttcataattgcggttggaacgggcgattacgggcttaccgatgaatccggttacctgcatgcccggctgttcaaagtccacggacagaaggttggctgcgatttcccttccgaacacggtatagattaaatccttcaggttatggttgcctgaggtgtaaagcttattctgattgttctggataaagcggatggagatgtcaggatgggacaaggcaatcttttccaccagcgcagccacatgggcgccctctgtcatgggcgttttgaggaatttcttcctggccggggtgttataaaacagattcctggcaatgatggtggtgccttccggggcgccaatctcctccagccccttttccataccgccttctatctgataccgggtgccggtgaggctgtccgatgtcttggtaatcagttccacctgggcaactgccgcgatgcttgccagcgcctcaccccggaaccccagtgaggatacggtgaaaaggtcttccacggatttaatcttactggttgcatggcgcaggaatgccagggcaatctggtcttttgctatgccgctgccattatccgtaaccctgatcatactgcagccgccgtccttaatctcaatggtcaccgcggttgcctgggcatcgatggcattttcaagaagctccttgacaacggaagccgggcgctcgattacctcccctgctgctatcttgttgattgtattctggtctaatacggttatattggccataaatgcttcctttctgtatgtggcttgccaactccaaaaacgccggccccaaacctttgccagggccggcttttattaattgttcttctctggggtaaattccctgacctgcacccacttaaccgtcttgcctgagcgttccgtaagtaaggtgcgcaggccgcttaaacaggctgcgcctatctgcttcttatccagcagatagcctccatggtcccttgtataaagcacaaggcactggtttgtctcgcagatgcgcgatatctggctgtactcaagggtccctcggccgccggaggtactgaaataattccggtaaaactcataggtcaccgtgcggggctccccgttcttgatgaggaaccgcctccatgccgtatccagctgcatccggttggaacggtccgagttaaagagtccgctgcgtatgaaccgcgggccaagggtgcggatgaaaaaagtaaggcttaggaatacggaggccgccatcaggctgccgcgtatcctgtattcacccatggataccttgataacacacatgataagggctgccagaaagcatataaagcatagacaaagcagaaaaccgaatgtggtccacaccctgagcggggcggaggggttcagctgcttttccactgataccatgtggtacagtgattcctgggtcatcttcatgtcaatggtataacaggccggatgatttctgtccagcgttccttctgcactcatacaggcttccttttccttgccacacaggcggccttccgcctgacaaatcccccttctttatatacaacaaaaccacgtaaaaaacaagcccttttttaaagatccatcaaaccgtccaggatgtgcaccgtcatgaccccctgctccaggtccacattgaggatgcagtcgccgatggccggaaggaggagttccttcccgtccttcatctggaccacatacacatcgttggcccctgtctcgaggacatccttcatggtgcccaggatttccccgtcctccgtgcgtacttcaagaccaatcaggtccgtgatgaagtattcatccggctccagctccactgcctggtccctggggattaacaggtctttggacttgtatttttcgatgtcatttatattatcatagcccttgaatttaaggatcaccatgttcttaaagaattttacctgttggatttcaaggggcagatgctcttttcccgtgtcaagaattacctcttttaactgtttaaaacggccggggtcatcggtggtggggaacaccttcacttctccacggaccccgtgggtagatgcgatgacgcctactctcagcatgtcttccatatattataacctttccctgtgaaatgtgtgaaaaaacctcaagtaagaaacaaaccgccagccttggggccagcggtctatcaattactgaatctcaacaattactttcttgtcttctttggatgcagcggccttgactacggaacggattgcttttgctatcctgccctgtttgccaatgaccttgcccatatcggcaggagacacctttagttcaatcaatgtatcttcgcctttcattgattcggtaacgacaacttcttccgggttatcgaccagtgcttttgcaatcacttcgactaattccttcatctctccacctcatttgcgtcttactgaatgccggcgatctttaagagctttccaacagtctcagtgggctgtgcgcctgttgctaaccacttcttagctgcttcctcgtcgaatttgattacgcttggttccctggtggggtcatagtaaccaacttcttcgatgaatcttccatctcttggggatttggaatcagcaactacgattctatagaaaggagccttcttctgtcccattcttcttaatctcatctttactgccatgtaattttcacctccttgtgattgttcttatattagacatacaggataacctgtttgactagcttaaccataccggctagaatggcagtttcatcttgccgcccataaggccgcccagaccgccgaatccgccccgcttcttgccgccgcccataagtccgggcatctgcttcatcattttcttcatctggtcaaactgcttgaccagacggtttacctcgctgatttccacgcctgcgcccctggcaatgcgctgcttcctggaggggttcatcaggttgggattggcccgttcctccttggtcatggaaaggatgatggattccaccctgtgcatggacttctcgccctcatccatatccacgccggagagctggctgcccatccccggcatcatggagagaatgcttcccatgccgcccatcttcttaatctgctgcatctgggtcaggaaatcgttgtagtcgaattccgccttgcgcagcttctggctcagttccctggcctgttcctcatccacttcagccgcggccttctcaatcagggactggatatcccccatccccaagatcctggaagccatacggtccggatagaactgttccaaatcggacaatttctcgcccataccaacatatagaatcggtttgcctgtgactgcacggatggaaagggctgcgccgccacgggtatcgccatccagttttgtaaggatgacaccgtcaataccaactttatcattaaatgaaccggatacattaaccgcatcctggcccgtcatggcatcaaccacaagaatggtctgatgcacatccacattgctcttaatctcaatcagctcttccatcatatcttcatcaatatgaaggcggccggccgtatcaaggataaccacgttcatgccgttcttggccgcatgttccaccgctgccttggcaatgtccactggtttgttcttatcacccatggagaaaaccgggattcctaccttttccccgttgacctgcagctgtttaatggctgcgggacggtatacgtcacaggctgccagcagtggtttcctgcctttggccttaagcttggctgcaatcttggcagtggtcgtggtcttaccggcgccctgaagaccagccatcatgatgatggtaatctcattacctggcttaagggcaatctctgttgtctcggaccccataagcttgaccagttcctcggttacaatcttgaccacggtctgtcccggtgtcaggctgccgaacacgtcctcgccaaccgcccgcttctgaaggtcgctgatgaactgtttcaccacacggaagcttacgtccgcttccagaagggccatcttgacttccttcagggctgccttgacatctgcctcggtcagccttcccttgctgcgcaggttcttaaatacattctgtaatttatcggataagctttcaaaagccatggataacctcctaagggcgcacctctgtcaacttacagggtgccggtgatttttcccgccaggccatgaatctgctctataagagccatatccctggtccgggcgcattcgtctgccagctgctctacttccctggccatatcacggattttcacaaacttggccaccagatgaagcttggcctcgtactcttccagtatcttgtcgcaccgtttcatcagatcatggacaccctgacggctgattcccagctccccggctatctcgctgggggaaaggtcattgaacaccacgtcttcatataccttgcgctggtgcgctgtcagcagttccccataaaaatcatacaacaaaccttgttccacaatcttttccatttcaaccacctgtgatatcatacacgatgacgggatgaatgtcaagcatttttacttgacaataaaaaatatttgtatgatggtactgctttaatcgtggtaacggatattcctgctgctggaaaccaggaagaaggaacccacgaagcaggccatgggcacgaactggtacaggtgcggatgtcctgggaaatatgtgttcccaaagatattgaatgcaatcccgcccatgataagcagcaggggcaggatacttaaaaagatgaacttccccagggaaacccgttcctttggcggcttgcacctggtcagcttcaccatgggtatcttggcaaagcggaaacggatgcatgtataggatgccagatattggattccctccagctttacaatggcatacgtctggtccaggcgcaccgtttcataggccatatggtgtttctgggcataaattgcagtctccctcgcaaaatcatgggggttcagcagctctccctccgcttcaatataaatgaaggtctcatggagttccttattataattggtccagtccctccggatgttctggaacagggacccctttttctcctcttcactgatttccttcaggcattgctccacattgccgggatccagttccggctcatcctccaggcggaggcacagctgtcccattttcctcaactgttccaattcctggtcaatctgggaccgccgtctggccatgatttccctcaatccaagggaaccttcaaaatattcccgtatgtccctgatggggacacccagctgccgtaacagctttatcttcaggaggcggcttatatcttcctcgctgtaattgcggtatcggttcccctcttcacgtccaggcgtcagaagttcctcgctttcatagtaccggatgtttttccggaccagcccggtacgggcttccacttcctttatcttcataaggaatacctcctatctctttctgtacctccattttaaaccatacaggaactggacagtcaaggaaatcccgggatattaagaaaaatgtcagcaaaaaagcagtcccggggaggtaaataccttccgggaccgcgtctgtgtccggcatgcctttttggcagcgtccggttttatctgactgctagttgctgttatagttcggtgtcaggacaatctcaccgcttatgattttttccctggcctcatccgcagccgcggcggcttcttccgttaccttgctgctgtatggcgcgatgctgatgacgccttcctttaaaccgggattctcaagtccgccgaattcaccggatttgatgatgtcaatctgggaggtgatcatggttgggatgctgaccataagggaggtcaggcaaaggtcatcctttacaagggatgcctggtcggaggtatatccgatacagaatacacccttttcctcacatgcctcaaacgcgcccagcccggtttcatcacaggtctggaggattacatccacaccctgttcaatcattgccagggcagtctccttgcccttggatgagtcgttaaaggttccggttatgactgtcttcacctccacgtcaggccttgctgccttggctccctcgacaaatgcgttcttgtcagatgcctgggtggtattgtcaccgccgccgatatagccgatgaccccgctctcactctggatggctgccaggacgccgcacacatatgcgccttcatattccttatagtcatagaatgcaatgtttccaggggtctcctcgccctccggcgggttgcctgtgatgaagaaatatttctcaggataatcttccgccacccggacgcatgcatccccgtactgcacaccgtgaccaatcacgaaatcatagtcctcctcacagtagcttctgaaggtggattccatgtcggcggcctgtacgtcctcggtatatgcaatcccatagccctgggcctccagttcctttaatccctcataagcgccctggttccaggacttgtccgtgataaagcccggaaggaggatggcaatcctggacacttcccctgcaggagccttttcccctgtggtgtcagcgccggcaccggctgcctctgattgctctgttttggcagcgtccgccgccttggtcccctctgtcttggaaccgcagcctgtcatggcggatacggtcatggctgcgcacagaaggaatgataatacgcgtgtagactttttcataactgttttctccttttagaatatattgttatctgctctccttattgtatatctggcccagatatccgggggcgtggatgttgcgcccgaatatgacgaggctgagcagggttactgcatagggcagggccacgaaaaactggtatggaagggttgaaccaagggcctgaagccgcagctgcagggcttccactgttccgaacataaaggccgcacacacggcaaacacaggattccatctggcaaggatggtaatggccaggcagatgaagccgcggcccgaggacatgttttccgtaaatgttcccacaatgccgcaggacaggaaggcgccgccgatgccggccatgaagccgctgaacatatatgtcttatacctgattttcacaacatcaatacctgctgccgcggctgctttgggattctcccctgccgcgtccacctttaatcccaggttggtatactttaacaggaaccataccacggcggcagctatgagggcacagtacacaagggcattgtgcttaaagaaaatatcgccgatgaacggtatttttgaaagcacggggatttctatgttcttaaggatatccaccttgatcttatccgtgctgacgccgtacacggcgcggtacaggaagttggtgaaaccaagggcaaatatgttgaacatgattcccaccacggactggtcctgcttcctgctgacaccccagaacgcaatgagaagggcgcctgcaagcccggccatgcctccggccaggataccgaggaaaaggctgcccgtgtgataggctgccatgaaggatataagggcgctgactaacatttccccttccagtccgatgttcatgacgccggaacgctcagacaccacatctcccaccgagccgaatatcaggggtacgctcatgcgcacgcctgccgtaaaaagaggaactaaaaatgcggctgttaaaatctcactcattttttcacctctcttttgtcagggcgtttctttttgcctgcggttccgaaaaagctgaagcccagcaggatgaacagcacgatcagggcctgcaggacgttgaggaacagggaggacacacctgtcttcacctgcatggtctcggctcccgaggacagggccgccaaaaggatggaggacaccaggacaccaacgggatggagcatgccgagaagggctgccaccacaccgtcaaaaccataggaacccgccaggccctccagaagacgtgtctgggtgcctgcaatctccaccgcccctgcaatgcctgcaaacgcgccgctgacaagcatggcggacagatagtatttcttttcactgatgccgccaaaggccgctgcccggatgctgccgccaaggacccggagacggtacccgaagctggtcttacggatgacgatccagtagatgaggagtccggccagggcaatcaggatgcctgcgttcatacgggaaccttcaaacagcttgggaagggtggacgccacctttgcggactgcgggatgttgcctttggagtcccgcaggggataataaacacagtaactcaggaactggaccgctatgtagtttaaaagcagtgtggtgatgatctcgctggccttgaactgtgttttaaaaaagcctgcaatcccggcccacaatgcgccggacaaggctgccacaagaagccccgggaaaatccacgccggacccatggccctggcaaagggcgagatgcccacaacggtcattccgatggcgcccaggcatatctgcccctctccgcccaggttgctgagctttgcctggaaggtaaaggatactcccaggcccacaatcaggatgggcaccagttttacggatatttccccaatgctccggaaggaacggaaggggcggatcagaaggtaataataggcttccaggggattgacatggaggatgctgatgaagatgcctcctattaaaagggctgccgccacggcaatcagtgtaatgaggcatttagcagccgcccctgcttcatggatggaatcaagtagtttcattggcagtcacccccatcatcatcattcccacttcacgcaccgttgtttcctcgggaaggacctcccccacgatcctgccccggtagagcaccacaatccggtcggaaagggcgaacagttcttcaaaatcaccggacagcaggagcagtcccattccttcatccctggccttaatgattttttcacgtatgaaccaggtggccttgatatccagtcccctggtgggataggcgcatatcatggcctttggatgtttgctcagcgccctggccagtatgaacttctggaggttaccgccggaaaggttggcgcttctgtccgtgattcccctggcccttacgtcaaagtcaaacatggcctttgctgcctgggtcttaataaaacggtaatccaggaaacatccctttttcggcggcctgcggttgcgcagtatccagttttcataaagagggaagtccggcacgctgccaacgtgattccggtccgcaggcacgtaggaaatcccccggtcaatgaaatccttggcattcctggtggaaaccttagcgccgtcaatcaggacccggcccccggccgcccttcttaccccggccagtacttcggccagctccatctgtccatttccttccacgctggcaatcccgaccacttcgccgggatacacggacagggacacgccgtttaaggtcatgaccctgcggtcgtcctccgccttcaggtcctgggcgcagagcacgggcaccctgtccctgtggtcaccgcggattttgtcaaattccggcggcgttacttcctcccccaccatcatccttacaatggtggacttgtccgcatcctttgtgtcaatctggcccgttacccttcctttggtaaggaccgtgatgcggcggctgattttcagcacctcatccagcttatggctgatgaagatgacgcctttgccttcactgaccagattggctatgatttcaaacaggccgtcgcattcctggggaagcaggaccgctgtgggttcgtcaaaaatcagcacatccgcgccggtatacagaagctttaatatctccaccttctgctgcatgccgatgctcagctgttccaccgggctgtgcaggtccacgtcaatgccgtatttctgcttcagctgttccagcgtgtcctcaatcttcctgcggtttgtgatggaaaatgtcttcacatcccccatcaggccgatattctcaatggccgagaacacatccaccagcatgaagtgctggtggaccataccgatgccatggcggagggcatccttgggagagtggatccggaccggtttcccggaaaggaatacctctcccctgtccggcttatagataccgtagattacattcatcagcgtgcttttaccggcgccgttctcccccagcagggcatggacttctccaggatacacggtaaggttgatatcctcattggcagtaaagctgccgaaggtctttgttattccttttaattcaagtaacggagtctggttgtccatgtatgccctcctgcttatttgcaatgtaccttacaccacagttcctgtaccggaggaatctgctccctcatgcctggggcaaggcggcaccagatgattcccttggtgggccttgggaactcatggcgcgtctcgatgatgcgcgtaggtgtcacgatgtagtcaatggcggtgtcatactcttccaccgtaacgtccacgtcagccacctggcagtcatggccggcccccacaatcacagaggtttcatccacaatgcccatggtatataacatggcccactccagatcaaagtacccatgtcccttgccgaaacggatgccgctgggcgtgatggcagatgcgccggtcaccagcatatcgatgtggcccacggactcttttaactgctccagggtctggtgcttccagtaacgggagaccccgtcaagcagggaggcaacctcttccttcccttccgggatgtactcaggacggatgaggaaaaatcccctggtaatcccgtagttggtcatgacaactgtcttcctgtcacggaatgctgtttcacgcagcgtttccaggttattgtccggcgttatgaaaatcaccttggcgttcttatacatatccgtggacgccagcagtgcggcgcccttgtcactgccttcataatccgcgataaactctgaaaactgccagctgaatttggaatccggccttgccaccttaagtaactcttcccagatttttacccttgctgtttttgcatccattttcatgcccctctcttctcctttgtgtacttattctttttcctcatatttttcacgtttattattaacacagctaatattagtatgttttttattgtttgtcaatcattaattaagaggattgcaaaatgtccctgggagggggagatatggtcccatgggaaataaaaaacggagtccccggacatatacaggaccccgtcaataaatgcggcttattcttattcttaaagtttggactgaatcagttcaagtacttccttcctcttaaggacagacagcttatatgttttcccgtccttcatggaaaccttgattccggtgggaaggaactgaagaagcggtccgaccttgcaaaggcctgcggattccatctctgaatatggaaggtccagggccgccacaaacccgcccctaaagatgatccgttcattcgtgaaccaatatttaccggatttctggctgtaaaaacaaagggttttttcccaataatcacctttcagttctttttcaatctgttcaccttcatgtaaatccaatgcatctgccatgattcggcctcctttgtatgttgtgataacgctaatccattatacactaggtataccggaaatggaatacaaaaaaaggaaaacctcctcagttttccttttccaatacaatttcataactgccgccgcttatcatcctgcgctcgccggccgggctgatgatctgtatcagccgccatccctgggcagcctcgctcatgatgatttccttacaccgctccagagtctccatattgccatttttcaagtttccgtctaagggaacttccacgaatttataatcaaattttcccataacaacaactctttctcttatgatatttgccttcattataatggtattgctcataaagataccattggaatttgcagggcgggtataaagattgtatatagattcaggaatgattcctgtttttatgtaaaaaaatggggatatggaacgtccggcgcccaaatccccatccatgacccgttccgcccacagggcagacggacctcttcttatttactttttacaacggataaccgcaccctattacagagcatgatatactatgctcaccgctctgacaatggcttataaacttcttcctgcattacgctggtatatgcgggacggataatcttatccatattgattaactcttcgatgcggtgtgcgctccagcccacaatccttgcaattgcaaagataggtgtgaacatctcttccgggatatccagcatgctgtaaacaaaaccgctatagaaatcaacgttggcgctgacgcctttgtagattttacgctcttcggtgatgacctttggacccagctcctcaatcatggagtacagttcaaaatcatcctcacggcctttttcctctgagagctgccttacgaagcgtttgaagatttcagctcttgggtccgacttggagtatacggcgtggcccattccgtagataaggccttttttatcaaatgcctccttgtggagaagcttcttcaggtaatcttccacttcctccctgtcctttaaatcctttacattcttccttaagtcagccatcatctccactaccttgatgttggcgccgccgtgctttggtccctttaaggaggccagggccgcggagacaacggaatatgtatcggttccggaagaggtgaccacgtgggtggtgaaggtggagttattaccgccgccatgctccatatgaaggatcagtgcaagatccagcacatgtgcctccacttcggagtacttcatatccgggcgcagcagccttaacaggttctctgccgtggacaggttctcgtccggacggtggatatacatgctggcatccctctcatagtggttgtaagcatggtagccgtaaacggccagcatgggcatgacactgattaacatcatgctctgcctgagcacattggggatggagatatcccatgccttgtcatcatagcttgccagggtcaggatactcttgcttaaggatatcatcatatccctggatggggccttcatcacaacgtccctgacaaaattcgtgggaagggtgcggctgaatgccaggctttccctgaactttgtgagctggctgtcaccgggcaactcaccaaaaagaagcagatacgcaatctcttcaaacccataccggttgtctctcaccactccgcctattaaatcataaatgttataaccccggtagaatagttttccttcacagggcacctttaccccgtccacaaccttgttggactcaattttggacactttcgtcagtcctgccacaacaccgttaccattcttgtcgcggagcccccgtttcacctcgtacttctcgtagagccccaaatcaatcctctcatcattcaggcagatatctgcccactgacttacattgtccataaattcctttgtctgaatcatgcaaatctctcctttccgttttcgatatagtttcctcctatgaaatcagtaatggtactattttaatatattttaccgattattgcaatactttcctattcttcttccaaatcttttaccagttcctggaaacggtcccgttcaaattcctgaatggaaatggactttttattgggatttgcaaacacgaatgtcttgtccacgttctccacatagttctgtatcttatcattggtggcgctgatgatggcctggaacccaaggccccggatcagctcgatgcagcttgccaccttttcggcatccattttggaaaatgcctcgtccagcaccaccaggcggatggtgggattgcgctccatcctgggggataggttgatgcggtatgcctgggcgaagctggccaaaagggccacatacaggggattctggccctcccctcctgaatttttcttaatcatccggctcaggcggattttaatcacctcatcctcattccggatcagctgctgcatgtcaaaggacagataggtgcggtaatccgcatatttatccatattgcgcttcgcctcctccagctcctggggcgtggcgttttccggcggtatgaagatgccgatcaggtcattgattaaaaccccgtactggttttcgtgctgggtggtgaaaaggtccagctggttgtcaaaggaatccgtcagctgggacgggtttacctccagggattcgtccatgaacatatcatagtacctgccgtccgcgcccttgttgcgcccgatgacaaactggtatttgtcctttccgaaatccaggcggctgatgatgcggttcagctcatccccgcggagcatggcttcccgtatggcgctgcggattttatacatgaagtcatttttaaaatgctccacggcggcccgggcctggtccgctgccttctgcctgtattcctccagatggtcgcaggacaggcttttaaggaggtggtcatatgcctggttatccttatggttcaccgggaaattccggttgggataacggcgcaggtagtcggtccttgcggtcatcaggtcctggaaggccgtgtcacggctttctgaaatccggctgcaccttgtgctgtagctttccttttcccggtcataccttggatggtccttggccgacaggtatccggccagttccgtgtccagcccgctgttgcttacccagccccgttcctgatccgtcagggccgcattcaggctgatggctgtattctggtaccggctgatttcattttccttgtcccggatcaggttcatcagcccgtcccgctcccgcttcttgccgtcgcaaaggcttaccaccgccttcctctcctgctccagctggtccacgtcctgggtcttcagcttctcaagctttgacagaagctgcttcttttcacgctgcttttcattccaggcgcccatatcccttaaccattccagatattcctccggctcaccgccaaggcgctcaaggctgaggatgcgctggcactcacgtacgatttcctccagaggttttttctgttcctccatggacttaagctcctgctccagaagccggatgcgcttcctcacactgtccttgccgatgtaagcaaacttactgtagttttcaggattgatgtgctggagccggaagctgtggtagagcaggcagctgtcggtgatgccgatccggcactggcggagttcctgggtggtggcgcatttgattacttttcccagcaaaaggtcgatgtagggctggatataggactcacgcaccgacacctcctcggacagggcgccctcaaggaccgtgggctggctttgggacagtttttccgtgtccaggacagctgcgttataatactcttttttatccagttccccatatatttccagggcaatacgggcatatttaggagggaccacaaggctcagcttctggctgccaagatacccctccaccgcattgcgccactggtcctttttgatgtccagcaggtctgcaaggatatggacgtccacaccctttccggtttcttccagcaggcggcgctgcaggaagcttctggcatgctccaggtatttaggatatgccttgttgccggaacgcagcttttccagttcgtcttttgtctgtttttccctgtttttcaggtccctaatctcagcggcagcctcctggcgctgcttttccgtgtccgcgcacatggaggcaatggattccttcaggcggcaaagggttttattgtcaatggtgcggttttcaaattcctcaatatcccagagggtctggttggaggtgatatcctcgtcttcccatgccttgagggactgggtggtctgctgccacctggcctcgcttttgcccaggcgctccagaagctggttcagggcctccgcctgctttttcaggtcctcatagccggttgaggcaatgcggcgcagcagatcgtccccctgttcggtcaggtccgcaatctgggtttccactgctgttcgcgtatcctcctggcgtttcaggtcctcctttgccaaggacagccggtcggccagtgtcctgacctgggactgaaggtccaggatttccagctttttcacgaagtaggcatatttctccagctgctgttccttttcctggtaaacaccgtatgcctgccggatacggttcagttcctctatctccgcgcaggtgtcctctatctttttgcgcatgcgtccatactgcatgacgctttcctgcatgtcctcaatgtggatgtcctgctccatgcagatgtattcttttacaaaatcttccagttttatgttcatgcggaaggggatggcccgtttgaacagtaaggggaatttctcaggatccagtccgcccaggtatgtgtcatacagcaccctgcggaaccgttcattgtgggaggtggcaaagcattcctccttgttgaaatgttcctggaggtaggattccacctccgctatggacatggtgcgcttccctgtgcggtatgcattgtcccacatagggcctttgtgccagaaaaagcggcgggaaatgtcgttggcggatgtctccacgtcaaacacgattcccacgcactggcattcccctgtgtcgctgcgcttcagttccaggacaatggtggaggaaaaattctggttcctgagataggaaaattcgttattctccccaatgttcaccatgccccgcaggtattcaatcaggctccggtccgagtcatcggccgctgccttgttaaagaatcccctgccgtccgtgttggcgtacagaaggatctgcatggcgtcaatcacagtggatttcccgctgccggaatgtccggtaaagaaattgatgtcctcattaaacgaaaggatacgtttattgatatagtgccagttgttcaggcagatcctggagagggccagaaaacggcctttattctccgtccgcttctgcggtatttccatctggggcatttccatctgattcatcttcgtctggttcagttcaatctggttcattttcgtctggttcattttcatctggctcatttccgcctggttcggttccaactgattcatattcatctgacccatattcatctgttccatcgtcctcatctcctctgtcgtccagtccggggggctgtatcaggcgttcccggtccacctcatccaaatccgcctttacctgtacgccttcatcctccgcgctttcgtcaaagaaagccagcagctgccgggcgtcatcgcccatcaggaccacgttgatgcagggatagataatcatgcggctctcgctgtttaaatcctccagcagatccaggggttccagtatctggtactttttcagcagtgtcacggcccgcctgatatccgtgggcgagggctgcttcttaaaaagacggtaattccccagcttttcgtgtatctccctgagggtggtatacacattcacactggtggacacactttccatctgttcatcataaatcagcttcaataccagcaggtacagggttgccagcttgggcagcttatcccccatcaggttcccgccctggatatagatgattcctgtctgggtattttccatgacctcaatcccgctgacagcaaagtaactgcggatgaattccagatgcttgttgcagtccctgaaatccgggttatactggaaccgccccgaacggcggtcaaatttgtgttccaggataaaggtctggtgaagcaggaggcgtatggacgcggtgagccgcgcctgttcctcctgcagcaacgtatcataataggcaatgccttcttcaagggccattatctcttcctccttgcaaatacaaacctgggatagctgtacctgccgttatgtatcatctcaggctccggattttccaccgtgtacgggcttttctgcctggtggaataatcataggccaggatcagcttctcaaactcctcatcgctgcgcgccgtgtccttgtcaacttccatgatcccgttttccatcctgccctcgatgaagtcctcgatttcctttttgctgtaacggttccttaccttgttcaggttcagcacctcttccatggacagttcctcagacacgtcctcgtcctttagctgttccttaaaatctgattttgtcctgcgtttcttatacagggatttctccgacaggatgtttagctgggacaggttcattttcccgcctattacctgtacatcctggtccgtgcagtcatattcagaaaggtggttcagcagctggatcacaaggcccttcatgttgtcctcctggttcaggaggtaattaagccgtgtgaccgtggcgcgcacataccgggtatgctctttgtccatattggcaatgcggtgttcaatatcatcaaagccccgctccagctggtccagcttctccatgacctgggcctccgtcacatcgggcggcctgcggccaaagaagcccgtggccctggaacacatgtgcctggtccattcctcgtcctggcgcatggcggtgatccagcgcttaatatctgttttgtacagatagaaattgtccgaggttttcaggatgtggtattttttattgacgatttcctccacataacggtccagatgctcctttaacagactgctgtaattcttctgctccagcaggcttccaaagaacttatccatattgtgcagcatgtcctgaagggatttgttcagcttcttggtattgacaagggctgtattcaggagggttatactggaacgggggtcatttttaagagaaaaaagaatggcatagacattctggatgtatacttcagtctcatcttcctcatcgcttgccagccttgcaaatgcttcaatcatcacggccgcgtaatcgggtatgacgatgttcacggtcatattggcataatcgtccaccttcctgagccagccgttcctcaaaagccagttgaggacgcgtgtggcgggcggttccagggtgtcccagtcatcctctgtctcgtcctgccagagcacatacttcttcctggaaaaatattcgcccagaagctggatacacatttccctgctcaggaaatagttgctgtactcgtattcctcgttgattttcaacagtgcctcaatataagtagaccggttaatggagcggaataagctccaaaaccggtccggtatctcattcataagtatcatcctaagcctccggaaacaacctgcttttggcagcggttttccgtactattataacaggaatcaggaaatgtgacaatcagaaatcaaaatcctccccagcgtttcaggcttccctcctggaacacgtattccggggtgaggaaggggtaggataggtctttggtaaaataccagggattcccctcgctgtccgggttcttcaggacatggaattcctgggcaggcatatagccctgggccagaaggaagcaggtctccccgtccccgttcacggccacatccgcaaccatgacgcagtgcccggggctgccgcctttgatgaacatgtcgcctgcctttagctggtccggggatatgggtgaaccctcctcatccagggagagggttcccgcatacatcatcacatatttcagatacaggaggaaggtttcataggaatcatcataggacgccttctttacccacgacacctggttcccgtccacctgaagccggttcccttccctccatgagggataatccatcagaaaaccattggtcaggtggaacgcaatcctgtcctggttccctgtggaccagaaatattccgcataaacgcggatgatgctgtccgcgcattgctgaaggtcgctgtcaaagacaggcaggtcaaatacggcttcgtgggcgccctgattccccttctcgctgccgtcataaagcaggacagggcttttatccgctttcaggggaaaccttctcagatactgctggaagcttccttccggcgcagcctcccttgtgtatccggcaggggcgggaaaacgttcctccaggcaggttccgtccggattgatggctatgctatccgtaccgctgccaggattgttgtatgatccatccgttggttgatggccggaatcaccgcccgtatcaccaccagcagcaccagcatcatctgcttcccctgcagatgcctgtcctatacccttttctgcggatacaatcctgaccccgtaaatcagattggagtagtcgctcagatggacgtatccgtcaatggggtccatggccgtgatgtcaaaaccatcctcctccgtgccggtcagcatgatccagtgcactgccccgcttttgcgtttcactttgacaatgggataccttccttcccttatcatgcggttgacggacgcggcggatgtatcgtcagacagatccacatagacccctggcagggcttcctcaagggccgcccacaggatggcgccgttttcattgtaaaccccgttttcattgaatatccggttcagttcaccaggcgtatggtcatatatcccctgggcttttaaagacgctgcgatacagcaggtcaggcagccggaggacgccatggtatccccggacccgcccagggtattgccggcccagtcatcgtccctctggctgtagtcaaaatatgcctccagagggaaccggcccgcataataggcgtcccctgtgacctggcttgcccccttccctcttctggtcagccagacagctgccgctgtcagtatgcaggccagcaccaaaacacccaccaggattccctgcctcaccgtatggtttctttttacatctcccaagaccctgcctccctgttcttaattgtttgcttactattttagcagatgttccttaggaaaatatttcatttgtttaacgattgttttaatctagtgctccatccagccagaaaccgtacttccagcactgcctattttgccatctgccgcgttgtcgtcagtcagcggaggacccactccgcttccctcctccgccttgcaggctgacaaaatatccagcactggcagtacggtttctgactggatggagcactaggccgtgttaagcggtcacctctttaccggacgcaccatctgctgcctccgtatccttttccagaagtttcctgattccctcaaaggccacaatcacaccaaggaccagaaggaggactgcaaatacaagctggagcgcattgccgaacacaaactggctggaaagggcggataccaggtcccgtatcttaagggccagggccgtaaaggtaacgcccagcatgatgaccatgggtccccagagcatcacgccctgtctgtgggtcctctttaagaacacggcgcatgcaatcagcgccagtgcggacagcagctggttggcagagccgaacaggggccagatgcttgcatagcctgcccttgacagcgcatagcacagggccagggtcagtatggtggaaaagtacttgttggtcagcacccggtttaaggaaccctggttttcaggagcaacatcatcgtttgtaaagaattcctggaaagcaatgcgtcccacacgtgccactgagtcaaggctggtcagggcaaaggcggaaatggacagcgtgatcagggtgtagctgacggaatccggcaggcccagggaggtaaggaacatggcaatggccttggcaaatacctggggaggcgtgccggttggcagcgtcccgcccgtggccagggcacccactgcaatcagcgcggtgatggccagcaggctctccagcagcatggcgccgaatgaaaccggaagcatgttcttttcattcttaatctgcttgctggccgttcccgaggaaaccagtgaatggaacccggatacagcgccgcaggcaatggtcacgaacagggttgggaacagataggaaatgttgccgttcccgtccatgaacgcaaaggatgtaaaggagggcaggttcatggatggattgtagacacagattccaaggaccgaaccgatgatcatggccagcagcaggtagctgtttaagtagtcccttggctggagcagcgcccagaccggggtgacacatgccacgatcacatacaggaatacaaagataagccagctgccctggggaacatataccgggaatgccagccccagcgcaacagcgaggactaaaagcccgatggccgccagtgtattcatgagtttgccgcatttcccgaacttcaggaaaaagccaagggccactgcaaacaggatgaacagcagggatgtggacgccactgcgccgttggcagcgatgcgccctcctgtggcggcatcgaatccattaaaggtaccggccacgatatctgcaaaggcggctaccaccaggatggaaaacagccaggtgaatagcaggaacagccgttttcccagcttgccgatatagagttcaatgatatagccgatggaacgccccttgttcttgacagaagcatacatggatgcaaaatcctgtaccgctccaaagaacacgcctcccaacaggatccacagcatcacgggaagccagccgaacatggctgcctggatgggaccgttaatgggaccggctcctgcaatggatgcgaactggtgtccaaacacaacattggtatcagcagggacatagtccaccccgtcctccatctcataggcaggcgtctttgcatcgggatccacgccccatttcctggcaaggtatctgccgtaaatcagataagcgccgcctaaaaccactacagctaacaacatcatcaataaaccgttcatattcaggtctcctcacattaagtatttatcatcaagtcttgatgacaaggagtttatcacttcagcgtgaagatggcaatggaaaattaacgatttgtttatactttatttatatatttttaataacttcaggttatacaaatgaatcctttatgattgccttaacaagaccttcaatatgatactgtgctgcggtgatgtccgccttatatccctggcgctccagttcgcgggcagtgaccgctccgatgcagaccagtttcggattctttggatgtactgcaggcccctgtatcccaaccgccttatccccggttcccccttggggcagacagtcgaaaaatgccctgaccccggacgcgctggcaaatgtaatgtagtcaaatcccattacctcctccgggataaaggaagcggacggctggcccgtcacttcatagaggacaatgtcgtcaaagtggatccccgcattgaggagtgtctgcgcaagtatgggggaaccgcctgcggacctggcaatcagcagcctgtcccccgggcttaccgcatggaccaggccgtctgccagggctttcgcacagtatgtgtccggcatatagtccgcgttgaatccatacccggacagttccctgcccgtaccgtccccgattaccgcaaacttcacatgccccaggcagcggcaatcccttccgtctttgaacagcccctggaaaaaaagccttacaccgttggcgcttgtaaacacaagccaggtataggaagggaggttccggtacgcggcctgcatgggggcttcctctatgtggtcctccaccttcatgtttaccagccaggaaacctgcgccccctgttccgaaagggctgctgccagtttcccggcaaactgctctgttccggtaatccccacccgcctgcccgcaagggggcctgcggtcctgtacttcatctcatatgcggccgtatccccgaccacgatgatggccggggtcccaagcccggcttccctgacacggctgcttatctgggacaatggggcccgtacaacccgctcgcccggcagcgtcccgttctctatgacagccgccggtgtgtcaggagactttccgctgtcaatcagctgctttgcaatcagtggaagctgccccagccccataaggaagaccaaggtgccgggtaatgtcccatataccccaaaatcaggcggaaggcattccattccggcctgggtatgtcctgtgatgacatggaagcttcggctgacagcccggtgggtcaccggtatcccggcgcattccggtacggcaactgcggaggtcacgccgggcactgtctcgtaaggaatgccgtgtttttccaaggccaggatttcctcccctccgcgtccgaacacaaaggggtccccgcccttcagccttacaaccgtatggccggataaggccagctccaccaggacgtcgttaatctcctcctgtttcatggagtgatgccctgcctgttttcccacatagattttcctgcaggtttcaggaacccagtccagaaaccgcttcgacgccagatggtcgtaaaccaccacgtcgcaggaggacagaagttccctgccctttatcgtcatcagcccggggtctcccgggcctgctcctaccagatacacacatcccaatctatccatcttacatcagtccccttcctgcctgcagggcaagcgcttccagttctttttccgtgaccgctccctccaggctgatccgtctcgtgacacggtccggcctgctgattccccatacctccatctttccatccatgatattggaatagatgccgatgggttcatggcagcccgcgtccagaagcttcagcaccatgcgctccagggtcaggcacagacgcccctcccggctgtcaatggcctggcagagcctggcggcgtcactgccctcccgggcctccaccgccatgattccctggcccccggcgggaatgaacaccgtggggtccagatatttaaaatcataggaagggtttcctagaaggtccagacgttccaatccggccgcggccaggatgataccgtcataaagcccctcctccagcttcctgagccgtgtgtggacatttccccgcagggtggcacaggttagactggcggcccccggccacagctgcccgcggtattccactgcttccagctgtcttctgggactggaggtgccgattacaatatgttccctgtccttaggggagcctttcatggtcaccagcacatccctggggtccccgcgcccggatacggctgcaatcaccagtccctcacccagttccatgggcaggtccttggcgctgtgcacggccaggtcaatggcgccttccttcatggcctgttcaaattcagagacaaatacccccttacctccgaattcctgcagcggtttatccaggattttatctcccagtgtctccttggtgaccagttccacctctatgtcaggccatgcccgtttcagtccgtctgcaatcagatgggtctggatcagggccagggcgcttttccttgtgccgatacggatgatattactcatgttcttgttcccgctttctgtttatgatagtctctgcctgggtgtccgtgagatggcagccatgttgaaggccttcttgtgccagctcatagaaaacagcagaacgtatggcaggggaatggggaaaccgttccttgacctgcgccctgtatccgcccagcctggcggccagacctcccagcccctcaggcattgccgcctttatcctgtcctttaagtacctggctatgacaggactcatccctcctgtggatatgcccaccaccacaggatcatccctgacaatggagggaaagataaaggaacattcctccttcacatccaccacattgaccgggattttcttaatctggcaaaggctggatatgtggctgtttaatgcagtgtcgctggttgctgcaatcacaaaatcagcgtcctcaatatcactgtcttcgaacccccgccgtgccacggacagggcatccccgtaaacgccgccctgcaccatatccaaaagtccctcacaaaggcagggcgataccacctggataagtggaccgtagggaatcaggtcgcgcaccttgcggcaggccacctcccctccgcctgcaatcagccacttccttccctcaatatctgcaaaaaacggaaaataagccaaatccatacctccttcaattcatgcctgtacccggtctgtcaggccaaagacactgaatgagacgcagacagacattttcatctgcccgcgtctcattccagcatattatccagtatcctgtcttttcatccgtgccttttggcatgactgcgcacccattctttggacgctgcttcagtcagcgcatgtcgcgctgctgtctgcgctcttccaggatccgttcaaaatcctcttccgtgaacccgatatcagccagcctctgtctgcgtttctcgcgcagctggcgctggcgctcacgctctgcgtcccggcgctttttaagccagagccagctccctgcaatgaccgctgccaggcagaggactccaatcccagccatgagaaggggggtgggcagtttgaagccaggggcctcctggcccgttccatccccggacggttctgttcccgcaggggactccccttccgaaggaggggcagccgcgtccacggactgggcccttgtggtgaacagccatccctcgcctatcttcctttcgttataggtatagaccagttttgccacggcctccttgggatggtcctttggcagttccgtcaccagttccctttcagcatccgtgaacccggcctcattgggaatggtgatgacggccgtcttatcgatataaagctcagacggctgatatgtctcaccgccaatggtgaccggcgtatcacctgtcacgtattctgtctcattatcagctatgttgacattctggaaccgggcaaagccgaaatccagaatggtctttgtgtctgagtaatgggttttctgggtgcttcttaaggtgactgcaatctctcccctgccgccgcgtctggcataggtcacaagggtctggcctgcctgggaggtccagcccgtctttccagccacggcgtccggataatactccacgctgttctcgtcttccgtgatcagaagcttatgttccatggaaaatgtccttccatccggattgttgatggtagccgggatggatgccttccttgtggaactgatttctaaaagctgctggttctggaacgcggccctggcaatcagggccatgtcataggcggacgtgcgctgggtgtcgtcattcagcccggaagggttggcaaaatggctttcctggcatcccaggtccgccaccttccggttcatcatgtccacgaacccggagcggctgcccccgatgtattccgccagggcattggccgcctggttggaggactggagaagcatcacatagaggcattcgcggacgctcagcacgtccccttcctccagggccagcttgttgccgcttccagactccacgttgtatactgcatcatgggagaaggtaaccttatcgtccagatcatcacagttctcaatgaccacaagggcggtcagcagcttggtgatgctggcggggatcttctgctcatgtatgttctgggcaaagagcacagcccccgaatccatatccatgacaatgcctgcttccgactgcacccctgtgtccgtgggccagtcaggccttgcaaaagcggttatggaagacatggttaagaccatgattaaacttactatgatgtatgataagcgacgcatatgtacctcttctatattttaagaatcaaacagcctacccatgattatattttaatccgggtcccctgtcaatcaattaaaggtcctattaaaatttcttatcctatctctcaaaaaaacttattggctttcctgcatgaactgaggtatactcttatacggtatgcaatgacagagcatgccgatgaatgataccgcggaggacccacatcatggatagtttcacaaaaatgctgaatgcccagctcatccttttagtttatatggcagtaggaatgtactgcatgaaaatacatctcattgaccaggataccaagaagaaactggtggacctgattcttaagataacccttccctgtatgatcttcaattcctttaacaagcccctgaccccccagatcctggtccagaccgccatgatcctggcagtggcgttctgcatctccatcctctcctatctgctgggaaaggtaatctacaacagatatccccaggacaagaaaagcatcctccagtactgcaccctggtgaataattcaggtttcctgggaatgcccatggtatcctccgtatacggggcagacggattgtttgcagcgtccattttcatcatcccgaaccgtatcttcatgtggaccgcaggacttgccgtgttcaccaccgccgactttaagacaaaatgcaggaatatcctgctgaatccatgtatcatcaccgtattcctgggcctggcgcgcaggatcagcggtttccctgtccccggtttcctggacactgccatcggcaacataggcgctgtcacttccccgctgtccatgatggtgatcggcaccatgatgattggcgtcccatggaaaaagttactggagcccagcctcttctacctggccttcatccgtctcatagccctgcccatggtggcgcttctcatccttaacagcatccgcgtggaaccaatgctggcaggcgtctcactgatccttaccggtatgccggcaggcagcaccagcgcgcttctggcagccaaatacggggccgatgaggactacgcatcccggtgcatcgtgacgactaccatcctgtccctggtcacgattccccttctgatgctgtttctgtgatgtgataccagttcttaccgctgtcctttgcagcatacagggcagcgtctgctttccggaacatttcctcataaggcatctgaccgcctttggcaagtacgattcccatgctgcaggtggcattaaagtcaggattctccttaagggccgtgtaaatccgttctgccgaccttgccacctgctccttatcctttacccctgacatgaacagcatgaattcatcgccgccgatccggcccgctatatcgtcctggcggatgcagccctgaagggtggcgccgaaggctttcagcacggtatcgcctgcctggtgtccccgttcatcgttaatatgcttaaagtcatccaggtccaggatgaagagggcaaggttctttccatctgcatcctcaatgcaggcacggcaaagttcctctgtggtggttttatttgtaaggcctgtcagctggtctgtctgggctttgcggcgcaggagcttctgcatggcaatggctgccttcagttcctcattctttttctgcaggatcaggttctgcagcttctggtgcctgctgtcatagcttatgaaaatgattcccatgaccataagcgatatggctatgaccgtgaccgcgaactgtaccggataggtgcgcacaaagtaactgaaccctttgcgttccccggcggacaggacggtcctgtaaaccgcctcatcaacgggactggaaccggccttggcaatggtctttgagaggacatggactaacagcgggtccgcctgttccgtcactgccatatataccgaggcactggccgtgcttccatccaccaccaatagcctggcgcccagcatgttcctgtccgctgaaatcttgattgaggaaaccatggcacagtccgctgtcccgtcctccactgccttcaggcagtcctccggagtcccaaaggtcagtacctcccacagtgggtatttcttcttcagcagttccatcaggccttccgcctgtctgaccacggcaatccgctgatgggcggaaaggttcagcgcctcatcccgcttgcccaccagactgaagctgcagctgtaaaaaggcgaggtataggacaggccttcatcatcactgtccagacggttcctgaatatactcatgattacctgggcatcttcatcggcaatgtcatccttaagggaactgcctgaactgcctggaacgaaatcaaaccgaaggccgcttatcttcccaaggtatctcatataatccacaaatgcgcccctgcacgttttagaaggcctgtcataccattcaaagggataatcgtcaggcgaaataagcacggtcaccgggccgctgcctttgatgaattggatttcctcacgggtgaactccgcaaactggccttccatgtccccgtaatatttgtcatagagggaggctgagtagtagggattttcaataaaaacctgtttcagcgcctggtccagctgttccatcaggtccggccgtttcaccgaggttatgaaataagccggcatatagtcaatcttggccagcagcttctgattgacattgaactccatgttgccgtttatgatggcatctacttcttccctgtccaaggcattgagaagctttgtaccggtgtcatacaatacggtttcataggtaaaaccgtggcttcccgcatattcctcaaacaggccgttgagataattgccctttatcatgcccacacgcataccgtcaaatccggcgtaatcatcataatacagacggttgtccgtcctgcgccccacaagtgcaacgaaatcaaagcagcattcgtagctgctgaacagataatccctggcccgctcctcactgtactcggccggaaggagaagttcaatctcccctgtcttaagcatcttaaggcactcttcccatgaggcctgtacatactcgtattcccatcccgcatattccgctatcttatccaggtactctgccccatagccataggcacggccgtccggattcatctggataaagttcccaatatccacacagcccacacgtaccttgtcagcggccctggccggaaacaggaacaaggcactgatggacagtgccaaaaagacagttaaccatatatatttgatgtatctcccacactccctcataccgcccacccagcatgttataattttttctctaaatcattaaatagattataacatgacaccaggggggatgccagtatttcatacaaaaaggcataaaataacagtctgtcaaagtgaacagggacagcagacaggccgtcagctatgtaaccagcgctgacggcctgtctgcatttaaactatggagtaatcaaatccgcaccaggcggtggtaaataatcagtaaatagccggtcagataaggcctgcacccttcatctcagccttaatcctgtccaatacaggaccttcgggagttgccaggttgggcgtatagggaagcccgatgttcctgccccttaagttagccatatccttggctgccacagggaagcttgcgccgtccatggaaagccttacgggattcagcttgaactgggcttccagggaaccggcaaggtcacctgcaacatacttgttgtacacatccactatcagctcaggcatgaagttggctgcggtacaaaccccgcccacggcgccgtggcacatagatgcatataacagggtatcctttccgccaaataccttgaagcctgtgtcacgcgtcctgcggatgaattcagatgtctgggtgatatcgccgctggtatccttcattcccacgatattggggatttcgcgggcaagacgctctaccagcctggcggacatggtataattgacacggcccggattattgtaaagcagcacaggggtctccggcacagcctccgcaatggtcttaaagtggaggaacagctcgtcttccgtgggctttaagaacatgggctggagtatggagataccggcagcgccattggcggcagccattttcgcaagcctgcagcatttcttagtgctgattgcaccgatgccgaagtatacgggaacccgtccgccggcctggtcaatcatgatcttcaagccgcgctccatctcatcttcttcaatcatatagaactcgccgttgctgccaaatgccaggatgcccagcacgccgccgtcaatcacataattaacctggtctcttaacttagcctcatcaatgaattcgttctcattgatcggggtgaggatggggacaatgacacccttgataaaatctgtattcatgacgcttctccttttaggcctgattatgactctactgtggtattggcaatcttctcataatacttgacaatgctggaatggtcttctttctcatagccgtctgcttttaatccctgcatgatttccatcagctgtcctgttaatggaaccggtgaactgattgcatgcgcagcgttcagggcattgttcaggtccttgatatgcagttcgatgcggaatcccggcttaaagttcctgctaagcatcatgggagcctttgcatccatgacagtggagccggccagtccgcccctgatggcctggtataccagttccgggtcagtgcctgccttcttggcaaatgtaagcgcttcagatacagccgcaatgttgacggcaaccacgatctggttcgccagcttggccacattgccgcttcccagctcgcccacgtatacaactgagcctgccattaccatcagcatgtcatagtacttgtcaaacagttcctttttgccgcctaccatgacggacagtgttccgtcgattgcctttggctccccgccggatacaggggcgtccagcatgtcaatgcccttcttggccagctcagcgccaatggccttgctctcggttgggtcgatggaactcatatcaattacaaccgtgcctggctttgcgccgtcggcaacgccgttctcacctaatacagccgcacgcacatgtggggagttgggaaccattgtgatgacgacctcacactgctctgcaacctccttaccgctgttcactgcagcagcgccgcatccaactacttcgttcacagcgtccttattaaaatcaaaaacaaccagttcataaccagcttttaataaattcttgctcattggctttcccatgatgcctaatccgataaaacctactttcatctcgttacctcacctttcagattcaattattagtgacttgtcattgtgaatgacctatgaccacattatagcggagcctgccctttcccacaattggcattgtcaatgaaaaaggcggctttttttatacaagccgcccattgtttcaaatatgatttcataattgaaatatttatttcatttttgtctcaaaagaatcaataccatacttcttcatcttcctccaaagggttgccttgctgatgttaaggctgtcagcggtccgttcccggttcccgttaaaccttccaagggcctggcgtatgagccgttcctcttccccgcggatgggtcctgacaggcctgaagcagcatcaccatcctgtgtctgtccgcggtccgggtacagctggtcatggagcctgcgtaccattatctcgtcgatacttctcttttccgctgtcagcaccagccggttcatataggtttccagctgcaggcggttgcctggccagtcatattccatgaggcattgaatggcgcccctggtcagcacatggtatcttgcatatttgtcacagcattcttttaataatgcctctgtcaggaattccatgtcttccgggcgtttccttaagggcgggacacacagcatcagcccgctgatcagatacagcagatccttcctgaacccgcctgccccggccaggtcccataatcccttaaggtccattgtagtggatgccatgattcggacatcaaagcgtacggtcctggcaaaatccctgctgctgccggttttataccgtatgagctggtacaggccgaactggttggacagggacatctgttccacgtcttctatatagatggtgccctggttggccaggaatacggcgcccttgtccccgaagattatgctgtgctgttctgtttccgaaagcccgttgcaggaaagggagaaaaatgccccgtcattatataaccctgcattgtgcatactctctgccagcagtcgctgttccgttccggtctccccgagaatcagtacaggcagtcctgactgggaatacagcctggccagatgtacacagtcctgcattgcttttgattgctgcaggacggactggaaacatcccctggcaatcaggccgtggtgcttcaactgcccctccgccacggcgccctgccggtccctggtctgtccctggcgcttgactttatggcaggtcaggattgcgccttctgtctcatcccccaccctgaccggtgccaggattgcaaaaacagcagtgctgcccgcctgcatgaaggaggaataactctcctgctttccctccagtacctctgtcagcttgccgtggtcaatgtccttaaatacatcctccatcttcctgccggccacctgtcccccgtccggtcccaggatatccttcatcacaggattcacggcagtgatcacgccatccttgtccatgttgaccacgccgttaaaggagtaatccaacagcgcctcaatctgggcattgctccttttctctgcccccatggcaaagtccatgctctccgccatggcaaaggcggtgcgcagggaatcctctgtcatggacaggaacagggacgggcatccggcttccttcgcagtccccacagccacatccccgccaatcaccaggtcagccccctcctcaatggccagcctggactgttccttaagccctgcgccgttggaggcaaagtaggtcctcagcctgatatcatagatgctttcaaagtatgacatgtcacagaacatgttcttcacgcccaccaccgcgatgaccggcatgtcccttcccacaatctgttttgccttcaccacaagaagggccatctcctgggccgtgacaacaatctcaaccacgggtatgtccgtgtactgcttgatgacggaggcctgaaggcccctggcaatcaggatggaggcccctgccgcaatggctttcctggcctccaccacggcattttcagtctggatgacgcgcatgtcgctgatggcatactttttttcctgaagaatattatgggcctggtaaagcatttcttcccttggcaccagaaggacaatctttcccatgcatccccctcccgtctgatggatatctgtttacttctccaaccttgtctttaacaactccagcccggccaggatcaggccgccaagcaggaaaaacagtatgctgaaggtctgaagccccaaaggctccatgggtacatccagggtagtcggccccttggtaatggcatacagcgaaccgatcatcagacccaggatggcgtagatggtctgggaacggtaacgctccaggcacattttaatgattttgatgattcccacaatcccggtgatgacacccatgccaaacacgaacaggatgggtacgtaattcaggttcatgtgaagcaattccttcacagccccgataatgggcacataaatgccgaatatgagaagcagcgtggaaccggatatgccgggcagcaccatggcggtgatggccaccatggcagtgaggaacacataggccaccagacccatcgacagatgttccaccgagacattaatgccctgtcctcccgccggattaaaataggagatgcagaacaccagcccaatgccgagaaccgtgaacaccaggttcccatatcttccccggatggaatccttctcctcccgtatgaccatgggcacagcaaaaaaggtaagtcccatgaacacggaactgatttcatatatatgttcctggaacagtcccgacaatacaagcacggacaggcagaatccggccacccatcccacgcctaatttaaaaagaaagaagaatgcctgtttccttctggcattgtcctttcccatcaaatcatttaacgagttaatgaactcatcataaaatccaagtagaaaagcaatggttccgcctgacacgcccggcacgctgtccgccatggccatacagaaccctctgattccgtttaaaagcacacaaattccctcctgtcgatttctccccacaattatacatgaaatatggggaatttcaagtaaaatataaacctgtatttcatttttcccttttatgtgatatcatagtgctaatttaactcataaaagcaaggaggtatagtatgtatgaactgatacagacaggcgccaggagcttctatattaactgccctgccaaaatcggcgtatttaagattgatgatacccggatatgtctgattgacagcggcagtgataaggatgccggaaggaaagtacgccagatcatggaccgggaaggatggagcctgcacgccatcgtcaacacccactccaatgcagaccacatcggcggcaataaatacctgcagcagcagaccggctgtaagatttacgccaaaggcgtggaggcggcatttacaagccatccccagctggaacccgctttcctgtacggcggctatcccttcaaagacctgcggcacaaattcctcatggccccggaaagccaggtatgtgacataagcgccatggaggaggatacggcgctttcggaactggaaatcatcccgctgccgggccacttttttgagatgatcggagtgcggaccccggacagaaccgtttttctggcagattgtctcagcagccgggcaacccttgacaaatacaaggtatcattcatctatgatgtgtcctcctacctccaaaccctggaccgggtcatggaaatggaagccccgctttttgtcccggcccacgccgaagccacggacagcatcagggaccttgccatatacaataaacaatgtgtccatgaaattgcccttaagctgctggacatctgtaccattccacagacctttgaatccatccttaagatggtttttgatgattatggcctgaccatgagcttccagcagcatgtcctggtaggttccaccatccgttcctacctttcctggctgaaggacgaaggcaggcttactgcatatgtggaaggaaaccggatgttctggtcggtatccgaggagtgagaaggcgcaaaacaggcaggggctgcacaacccaaggtcatacagtccctgcctgaatgcaatcccctattcgccctggagcgcatcaaaaccctgctctcccgtccgcaccttaatcacgttctcaacatcatatacgaaaatcttcccatctccgatatttcccgtataaaggacttttctggcagtttcaatcacctcggacacaggaaccttgcttacgaccacctccagcttcatctttggcaggaaggccacttcctccaccttaatgcccctgtagtaattgacatggcccttctgggtgccgcagcccatgacctgggtaaccgtcatcccggtcacgcccagccccgacagggcatccttaagcgggacgaacctggcctggttaaacaccatgacaatcttggtcagctttgttgtaccggacactggtacggaggctgggaaatgttccactgcaacagccttctcaacggacatatcacgtgtatcttcttccgtttccttacccgtgaataccattggcatgaagtccgcataagaactggaaaggttgtgttcggttgcatccagcccctttgtctcctcttccctgctggcgcgcagtccgattgtcttcttcagcacggtaaaggtaatggtcatggttaccgcgacccagacaatcactgccgccacgccgattagctgtatacccaggaaatgaaagcctcccccgtacaccagtccgccatccgctgcaaacactccggtcagcagggtgcctgcggcgccgcacatcccatggaccccgatggcgcccaccgggtcgtcaatcctgcacaccttatcaatgaactcaatgccgaatacaaccacaaaagcagcgatcagaccaatgaagaatgcgccggccggcgttaccaggtcacagccggccgtaatggctaccagacctgccagggaaccgttcagtgtcatggatatgtccggcttcttataacgcagccaggtgatgatcatggttgcaaccgttgcggttgcggcagccagattggttgtcacgaaaatatttccggctgaataaacagatgcgtcattatccatggataccgtggaacagccgttaaacccaaaccagcagaaccagaggatgaatacgcccaaggccccgagcgtgaggctatggcccaggatggcgttgggttttccgtccttatcatactttccgatacggggaccaaggattttggctcccaccagcgcagccacgcccccgcacatatgtactgcggttgaacctgcgaaatcatggaagcccatctgggccagccagccgccgccccagatccaatgcccggatataggatatacaaccgcgctgatgacagcgctgtagatgcagtatgatatgaatttcgtgcgctccgccattgctcctgaaacaatggttgctgctgttgcacagaaaaccgtctggaaaatcaggaaagccggaaggggaacaccggaaggaaggatactgctgtaatcaccccttaccagggggtcaaatcctccaatcaaggcgcctgccccgccaaacatgatgccaaatccggtaagccagaacagcggggtgccgatggcaaaatccatcaggttcttcatgatgatgttgcctgcattcttagctcttgtaaaaccggtctccaccatggcaaagcctgcctgcatgaagaagacaagggctgcgcccagcaagacccagattgtgtttactgctgaaaattccatagaatgttcctccttgagttttgtaatggggatgtctgaaatacaaaagggtgtattgccgccggtacctgacgattgcaatacacccctttgtgtactctgttactcacgtaagaacaggaaaagcgccgggtgttaagcaccagcgcttttctttatgtggcttattatagtgtcccatgttttaaaagtcaaccacaaataaatatttcgttaataaattataaaaaaaccataaaatatatcctattttcagcaaaacgcagaaatcatcttctgcttgcagctttccagcggctggcctgggccacaaactgttcattcagccagtccacgcctttggcgattccatccgcgtcaaattccaggaggattttttctttctcctcttttggggtagcatcgtatccatatggctccggccacacgcagacacccagcttaggcttttcctcaccttccacctctgtcttttccatccggaaacgcattccctgatggctgcccgtaaacttttccttcttcaggaaattaacaggcatgaaatcttttaattccagcataatacacacctgcctgtctgaagtaatcgggattatttctcgttctcacccagttctgccagggtgagtgcaaggctgctgatatccccgtcctccacctggctggccgtgtaaagggtgtatttcgtactgccccattcccaggcagccagacgtccgccgctttccgtggtcttgatctgtatctcagccgtctgtccgccgcttccggctgtttcggtcaggacgccgtccttaaaacgctcaaatattccagcaaaatcctctgccgtatccgatgcccggtaggtataccctatatcattgaaggtgaaatggatatcagccacctctccgttaataataaaataggacggctccactgcttcctttggcagcaccatatgaaccccgattttctcaaaggccaggacattgtccacctcctccatggggttgggtatgcccgcattcccagtggattcctccgccctggcagacgtctcagccggcgtggcttcggttggcgcaggttccttgcctgcacacccgccaattatgcatgatgccagcactgcagtgagcaggactgcccttttaccggtcttcatataaaaatccatatacattcctcccttcgatgcaatcttaattgcgctccagcccaactgtctcacaatactcctggagggtccggtgcagctggccttctgaagtctcatcgcacagtacgacaatcttatccccggcacgcaggaccgtatcccccctgggtacgaactcggcgtcgccccgcatcagcgaaaccaccaggcaggtcctgggccatgcaatggcagccaccttctgtccttcggcggcgcttccgtgataaatcattccctccaccaggaccttttcccctgtgagcgtggccttcttatccgggttctgtttggccagcagacggtgtaacagctggtcatataccggcgcacagcgcaggatatcaggcaccagataggctgccagggacaccatggacagggtcagcaggtgtgagaaagaacctgacatctcgctgatcaggatgattcctgtaatgggcgccctcacaatggctgaaaagtacccggccatgccaaggatgatgaagttgaccaaaagccctgaaagcgacgggcttaagggttccgccagacggtaatagatgcttccgatgatggcccccagcaccagcaatggcaggaatatgcctcccggcgccccggagccgaagctgaccatggagaagcagaatttgaccaccagcagaagacagagggaaccaaggacaaaatcaccggcagacatctcttccaccagcgcatgcccgccgcccagaacgccgcggtacagaaagccgaacacgcctgcaagaaggaagggtatcagtacccgcaccaggcgccagggaatcctctcgtacaggtcctgggtctttgacaggaccgtgttgtagaccactcccatggccccaatcagcacaccgagaagtagcacatgcccgtaagtgttcaggggcatcatgtgggtgatggtaaaggtaaatacaggtttcaggccaaatacgttcctggatacaaagtcggatgtgatggaggccgccatggaggataacagcagttccggtgaaatgtgcttatgtacctcctccagggagaacaggatacctgcaatgggtgcgttaaaggcagctgaaaggcccgcgctggccccacaggtgatgagcagcttctcttctgtcctgaccctttttgtcagtcttgagaatcctttggcggccatggcccccagctggatgctggggccttcacggccaagggacaggccgcatccaagggacagtatcccgccgcccagcttggcaagcaggacccgccaccagcattcgtcaatctcgcctatgatctcgccttccacctggggtatgccgcttcccgagatcagggattcccatttaagcagcccggccaccacaaaggctgccgctgccaggataaggaaccaaaccgggatgaaccaggtgttggccttcccgtaatccaatatggcatttaaaagtgtatccgcatatccgatcagatacctgaaagccaccaccaccgcgcctgcaatggcacccactgccactccttccaaaatcagttcatagcgaaaactccggtacctgttgattgtatgggtaaccgtatgttgttccggctgcatgatatttcccccctgtatcttacatctcgctgtatgtgcctttgaacttaaccagctttggacggtagcctgcgcctgtcagcgcggcaacaatctgattcttgtgttcggtgccgaacgcctccatggtgatgcgcagttccacggcagcgttccggttgatgctgatgaactggttgtgttccagcttgatgatgttgccctgttccctggcaagcagggaggaaaccctggccagttcgcccggcttatcaggaagcagcacggagacagtgaatacccggtccctctgaatcaggccgtgctgtacaatggaggacatggtgatgacatccatgttgcctccgcttaagatggaaacaatcttctttttctgcacatccatgtgcttcagcgcggccacggtgagcagccctgaattctcaactatcatcttgtggttctctaccatgtcgaggaaggccacaatcagctcgctgtcatcaatggtgatgatatcgtccacattttcctggatatagcaaaacagcttctcacccggccgtttgaccgcggtgccgtccgcaatggtattgacctcgggaagggtggtcacctggccctggcgcagggattcctgcatgcagttggctcctgccggttccacgccgatgatcttaatcttgggattgagaagcttggccagggtggagacgcccgtacacaggccgcctccgccgatggggactaatatgtaatccacggtcgggagttctttgatgatctccatggcaatggtgccctgtcccgtggcaacggccaggtcgtcaaatggatggacaaaggtcaggccctgctcatccgccagtttataggcataatcacaggcctcatcaaacacatccccctccaggaccacctcggcgccgtagctcttggtacggttcaccttcatgaggggggtcgtggtcggcatcaccaccgttgccttgacgccggccagcttggctgcatatgcaacgccctgggcatggttgccggctgaggcggtaatcaggccctttgccttctcctcctcattcagggtactgattttataataagcgccccttaccttgtatgcgcctgtatactgcatgttctccggcttaaagtataccttgttgccggtctgggatgaaaaatattcgctgtatacaagttttgtttctgtcgtcacttcccttacaaggtcggacgcctcctcaaatttctccagtgtcagttcttccataatcagtccttctttccctttaatatcctttactatatcacgtcaattcattaaattcaaggatggattgggcgccattactctgctgtcttcctctgtacgttgaaaagtgcattgacaaaatcgtctgcattgaacttctgtaaatcatcaatctgctcgccgatcccaatgtatttgaccggaagccccagttcagactggatggcaaccgcgatgccgcccttggccgtgccgtcaagcttggtcagtatgatgcctgtgatatcagccacctccatgaactggcgggcctgtgccagggcgttctgtcccgtggtgccgtccaggaccaccagagtctccctgtatgcatccggatattccttgtcaatgatccggttgattttcctgagttcctccatcaggttcttcttattgtggagccgtcccgccgtgtcacagatcagcacatccgccttcctggacttggcggcagccaccgcgtcatagatgacggccgcagggtcagagccttcctgctgggcaatgatgtccaccccggcccggcccgcccattcggtcagctgctcgatggcagccgcacggaaggtatccgccgccgccaggatcaccttgtgtcctgaatccttaagctgtccggccagcttgcccacggacgtggtcttgcccacgccgttgacgccgatgaccaggaccacggacttcctgtgttcaaactcataggcgttctcgcccaggtccatctgctccttgatgctgtttatcagaagctccttgcattcctccggctccttgatgtgctgctcctttaccttggcccttaaatcctccacgatggacatggtggtctggatgcccaggtcgcccatgatcagggtttcctctatctcctcataaaagtcgtcatcaatggcggaaaatccgctgaagatagagtcaattccagatacgatattgttgcgggtcttggcaagtccttctaccagacgtccgaaaaaacccttttttccctcagccataacctttactccttatctgtcatatcaatttatcaatcatcatatcatattccgttttaattttccaggtcatctgcaatcaggttcacggaaaccagggtggacacgcccttttcctgcatggtgataccgtacaggcggtcggccgccatcatggttccccttctgtgggtgatgacaatgaactgtgtattcttaatcagcttatgcaggtatccggcaaaccggtccacgttggagtcatccagcgccgcctcaatctcgtccaaaagacagaagggcgagggcttcaggttctggatggcaaacagcagggatatggctgtcagggccttctcgccgccggacagctgcatcatgttctgcagtttcttgcccgggggctgcgcgatgatctggatgcctgcttccagtatatcctcatcctccatcagttccagtgttccccggccgccgccgaacaattccctgaataccttgtcgaattcagcccggatttcagcaaatttctcctggaactggcggcgcatgcccatatccagctcctcgataatcttctccagctcggcctgggcctggatcaggtcatcatactgtgtcttcatgaatccataccgctcagacacttccttatagtcctcaatggaattgacattgatgttgccaaggcctttaatcctggacttcagttcatcaatccgcttcctgacctcggaggctgactggtattcttccttcttaagttccagcgcagtggagaaggtcatctcatattcggtccacatgtagctggtggatgcctccagtttctcctccagcttttcctggctggcctgtacgcggaacatatccttatccagttcggcaagacgggcggtcagttcctcacgcttggcaaagaaccccttctgctccgccgccatcgcatccttcctggctgtatgtcctgcaatcactgtctccagttcttccatcctggcctgggcgcctgcaatctgttcccggatccgttcaatctcctgcttcttcccaaggatgatctgttccgaactgccgctgccagcttccagggactggaattcttcctccagcttgcggatttccccgcgcacacggattgtattctccttgatgaaatcctgtttctgggtcaggttggctgtttccatctgaaccgcggacagggacgtggcggctgtctcccgctccttcctcgcatcctccaggagaaggctcttctcctcaatctcctcattggcctggatgttcttaagctccagcccgcgggtatcgtcctccagggtggaacggctctgggcaatctcctttacctgttcctccagctgtccatgttccctgacaaggtcgctggaagaatccgcaatctcagctttcttgtcctccagctgggaaatgttcatgcggatcgtattttcctgtaatgccagcttctgtatccgggcttttaactgctccagctcgcccttcttctcctgggcaaggctttcctttaatgccagttcattctggatcttctctatctgaaccagggccttgctgcaggtttcctccagctcctcaatctccctgcggcgtcccagcaggttactgctgttcttaaaggcgccgcctgtcatggaacctccggcgcttaaaagctcaccctccagggtgacgatgcgcaggctgtacctgtacttcctggcaagggcaatggcgttgtcaatggtatccacaacaaccacccgccccagaagataccgggccagccccttatactgtccgtccacctggaccaggtcgtgggccagtcccaggacgcccttttccttaagggccgccggctgtgaaaagttctggctgccgttgatgctggtcaggggcaggaaggtggcccttccgtaccggttctttttcaggtattcaatcagctgcttggcggttgcctctgaatccgtgacaatgttctgtatacttccgcccagggctgtctcgatggcaatctcgtatttctgttccgtggaaatgatgtcggccaccaccccgtggattccgtggacccggtccctgacctccatgacgcgccggatgctgttgccgtatccgtcataccgttccgccaggttttttaaggactccagcttggtataggccatatggtattcctgctgggtgtcgttctggttgcggtttaaccgtttggcatcggcttccgcctccatcatggcgtcttccgcctcctgggccttaaactgcctgtcttccagctgctgcctcacctcatccagggccgcctgctccctggcaatcagttcgtcctggaccgattcatcgcttttatatttaagcagcttctgggtcacttcactgcgcctcaggtttacctgctccagcatggtttcatagcgctgctggcgcgctgtcagggatgccttctcgttgagggactggatgatgatgccctttgccgcctcaatcgactcatccaggctccgtataagcccatccttgctgttcagctgttcctgagcctgttcctggcgctgcctggcatcggttacctgtgtttccatcctggcatattcttcctcataggaggaaagctgccctctcctggactccaactccccggtgatgacggtcctgcggctttccaggtgttcctcattcatctcctcggtatgtatctgttcgttcaggacattaatctggccttccaggctgccctttgacacggtcgcctggttcagctcctggcggtctgatgtaatctgtccttccagaccagcaagtccctgctccagcttctcatattcgttcttaagacgttcggattcctttttggtatcctccatgtcccctgacaaaaggctgcgccgcctgcccacctcttccagctgtctgctgatgttatctgtatccataaggaacaggttggcgtcgcagaccttcagttcctcttttaactgaaggtattccctggcagccttggactggcgctccagggggcctacctgcttctccagttccgacaggatgtcgcttacacggaccaggttggcctgctcgtcctccagctttttctgggcaatgttcttcctgcgcttgaatttaacaataccggcagcctcgtcaaacagctcgcgccgttcctccggcttgccgcttaagatcttatcaatctgaccctggccgatgatggaatatccctctttaccgatacccgtgtcatagaacagttcgttgatatccttaaggcggcatgcgcttccgttaatcatgtattcactttccccggaacggtacaggcgccgggatacggtgacctcgtcatagtcaatggacagctgatggtcgctgttgtccagggtaatggccacataggcaaagccctggggcttcctcatctctgtcccggcaaatatgacgtcctgcatgctggcgccgcgcagctgcttaatcctctgttcgcccagcacccagcgcaccgcgtccgccacattgctcttgccgcttccgttagggcctacaatacccgtgatgccgttgtggaactcaaacaacagcttattggcaaaagatttgaacccctggatctcaatactttttaaatacatacttcacctgcttattattttgcgtctgtctcaatgtcctcagccctgagtttcaggataccgttataggcagccacctgttccgcggccttcttggtgcgtcccatgccgcggccgatctccgcatcgccgattttcgcgcagacctcaaatgacttgttgtggtccggtccttcctccctgaggatttcataggacagggcttctgcctgccggctctgcaccatttcctgtaagatagtcttgctatcataaaagagctgcttatgttcaatatcgttcaggatgaaacgatgaatgaactcttttgcattagcaaaaccaccgtccaggtagatggccccaatcagggcttccattgcgtcgcttaccacggaattgcgtccccgcccgccggtggcatcctcgcccttgcccaggaacagatactcccccagccggatatcccctgcgcagtatgccagtgtgggttcacacacaatgctggcgcggattttcgtcaggtcgccttcaggcagcgtggcatacttgtggtacaggaaatcgctggtcacgatttcaaggacagcatcccccaggaattccagacgctcattgcacctgctgtggtccaggcggtgctcattggcataggagctgtgggtcagggcctgggaaaacaggctctggtccttgaactgataatcaatcctttcttccaattctttcaaatggccgttcatactatcccttctttcttacatgataggcaaaatgccagaaccggattggtcccatgccctggctgtaaaacgcacaaaaagggctgtgctcacacagcccctgtgccatcattaatttaatgcgttcttaatctgctctactgcgtcgccaacactcacaatctgttctgcagcttcatttggaatctcaatgtcaaactcctcttcaattcccatgataatctggaaaatgtccagtgagtccgcacccaggtcatctacgaatgtagctgccattgtcacttcctccggttcaatgttcaacacttctgcgataataccctgtaatttctcaaattccatctcttagctcctctttcttaaatcttgtttttatattcgtccttcggacttattccacgcggtccgtacctaaggatccacggatcttgtcgttaatcccctgttccttaaacgtcacgcactgaataatggaattgcgcacctctgtgcgctttgagttgccatgggtcttgaccaccaggccgttaaggcccagaagcggcgcacccccatactggctggcgtcaaaggccttcagcgtctccttcagggcgggcttaacaagcagcgccccgatcttacttcttaaggtggacatcatgccgcccttgaccatgccgattaaagtggccccaaccccctcatagagcttcaggatcacattgcccacaaatgcttcacagacaatgacatccgccgcgccatggggaatctccctggcttcaatgctgccgatgaaattgatacccggacattcctttaacagagggaatgtctccttcaccagcgcattgcccttttcttcctccgcaccgatattgacgattgcgacccgtggattgcggattcccatcacatgttccatatagatggaacccatctgtgcaaactgtaccagatgggatggcctggcatccacattggctccgcagtcaatcaaaagtgatacgcctttttccgttgggatcaagggagccagcggcggtcgttccaccccttttatgcgtcccacgatcacctgtccgcccaccaggatggccccggagcttccggcggaaacaaaggcatcagcctcccccttttttacaaggttcatacctaccactatagaagagtccttcttcttcctgattgcattaaccggcggttcatccgtggcaattacctcggtggcgtttaccacctggatctgttccttattgtaggtggatttgcttaattcagcagttactgcctgctcctgccccacaagaagcacctggattcctggttttgcgttcacggcgtctacggcaccggccaccatttcgcccggcgcataatccccgcccatggcgtctacggctactttaatcataatgactctcctttcggtcctgcatacaacttataatatactagatatcattctataaatcaatatgttttttatccggttttctgaaaagaagggggtgttaaaaaaaggccctaagacctccacaccgccagttcctccatggattttctcggccttggcccaggggcttcatccgcatatcccaatgccatggctgccgccagggtccccttaacgcccagccacctgttcagttcctcataagcaaagaaggtgtcgcatatccacaggctgcccagccccagttccgttgccgccagcgtcatgttctccatggcggcgccgattgactgtgcattgcagatttcgtagatgcgctgttccggcgtggctggtgaatccaggtccaggcccaggggattgatgacgaacagggtcacgggcgcctgttccatgatgcgcagggtgtaccctgcgccgcctatgtgctgcctgctttcaggaagcagggcatcccttccctccttttcccgcaaaaggccctggcccatggcttttagcattcccttttttgcttcccctgaaaccacgatgaacttccagggctggcggttcttggaggagggcgcaaggcttccggcataaaggatttccccgatggcttccctgggaaccggcgtatctttgtatttccttatactgcgtctgtttaaaatggatggtatcaagtgtttttcctcctatgttccatgtttgtgccgcatgcccctgcttcagcttccagccggctgaccagcgcgtctgtattccggatatagtcatcgttgattaaggtataagggcagccggatttcctgcactgttccaggtacctgctgttttccttaagaagccgttccattgtacagtatgaatcatccatccgctgttcgatgattccggcatatgacaggatatccttaaaatggctgcggatataggtactggtcatgataaggcagccgtacaggatttccttctgatactccggtccaaagccttctttccagtcaaaagggatgtaacagccttccacaatcaggttctggcggttttctatggcggtcttgatgatttccctgaccattggccagagatacgaaaccagcccttcgtcatccgccggcgtaaggtttgtcatgccgcttcggatcaggcccattttcagatggtccatggacagatagggatatccaagcctttccaacagccgctgtgccaggaatgtcttccctgtatgggaacagcctgcaattaatattatcatggttccgttacctcctgtcctcccattatatacgcattcatggcgcccgtccagggcgattggacggttttggcaatccagatgcatgaaaaatccatctgtgtcatactctgtgctatactatacccaggaggacatgcccatggaacggacttatacaacatcagagctggcgggtatcataggaatccatcccaatacagtgcgcctgtatgaagaactgcacctgataacagcgccagagagaaaaccaaatggctacaggattttcacggaccttcacctggaccagttcatcaatgccaggctggcatttcaggtggaaatcctccagaatggcctgcgccgtctggcggtcgatattgtcagggccacggctgaatgtgattttgacaaggcaatccatctctcccaaacatattgccgccagattgaaaccgagacaggtcatgcggaagaagccattggaattgtgaaggacatgctggccggaagggatgaggggaccggaagggatgagggggccgggacactctgcctgggcagaagtgaaacagccgcatatctgggaatcaccattgatacccttcgcaattgggagcttaacggactattaaggattaagcggaagaaaaacggttaccgcatctatacggatgctgacatcagacggctgaagatcatccgctccctgcggtgcgccaactactcccttaccgccatcctgcggatgctgaccgccctgtccgctgacccggatacggatatccgcgccgttatcgatgcggccgatgaaacggtcataactgcctgtgacaatctgctttcctcactttcacgcgcagcggcaaatgcggaccggattcaccataacctgtgcaggatgaaagaaaaatatcatttaaaccctccactttaacaccaggctttgtcctggtgttattcttttgtagaaaaaatcaaggaggtcatgtcatgaaaacagacattggttcaacgaatatgaatccggcccaaacggatccggcccatatggattcagccatccatgtggaaaaactctcaaaatactatgacgggatagctgcccttctaaacctgtccctggatgtaaggaaaggggaagcctttgggcttctgggggctaacggggcaggaaaaagcacatccatcgagtgtatccttggaacaagaaaggctgacagcggttccgtatccatcctcaggatggacccaatcatgaaccgcagggagctgttccaaagggtaggcgtccagttccaggaatccagttatcccgaccgcatccgggtccgtgaactgtgtgaggaaataatgtccctctacaggcatccgattccctatgggaacctgctgcgccggttcggcctggaggaaaaatcagggagcatgataaacgatttatccggcgggcagaaacagcgcctgtccgttgtccttgcgcttatgatggacccggaagtggttttcctggacgagcttacaaccggcctggatgtaaaggctcggcgtgatgtatgggaacacctgctggaactgaaacagaatggcaccaccattttcctgacatcccatttcatggatgaggtggaggcgctgtgcgaccgcatcgccatcctggcacatggccgtgtcatctttcagggcacggtaaaagaagcaattgatgcaagtccatacaggaccatggaggacgcctatatctggtttacggaggaggaagaaaatgaacacattcagaacaatgcttaaaacagaattaaagctgtctgtccgcggtatggacatggtcatcttcgggctgtgcctgcccgtggtcatggttgtgatctttggcgcggtatttgggaacaggccggcctttgagggcgcttcccataccttccttgagcagtcctttggcgcactgtccgccattgccatctgcgcaggcggtgtaatggggcttccactcctgatttccgaatacaggcagaaaaagatactgaaacgtttccgggttaccccggtaagccctgccctgatcctggcggtccatgttgtcatctatgccatctatgccctggtctccctgatcctggtctatgggacggcggctgtattctttggtttccggatgcagggtcctgtcccggctttcatcctcagctatctgctggtgatgctgtccatgttcagcataggcctggtggcaggcggtcttgcgcctgatacaaagacagcaggtatcattgccagtatcctctactttcccatgctcctgttttccggcgccacgctgccttatgaaatcatgcccggccccatgcaaagggcagccggcctgatgccacttacccagggaatcaagctgcttaaggcagcctccctgggacagcccctggaccaggtgtggtttcctgtcctgatactgggggccgtcttcgtcctttgcagcggcgttgcgctccggttcttccggtgggggtaaggcgggggcatggcatgacacttccccacccccatcccctgcgtctcacccgcccatgaaatccataaggcttaactgctccccttccctcttgtcctcaaattcatggatgtaggaaaacagcgggctgatatctgtcttcagcccgctgtccctgcacgcgtccttgaacagcttcatcagttccttcctgtggggagtgcccaccgcataggcatttccataggtatccatgtactttttcttaagtccagggaaatgcgcatccagctgctgataaaaatactgcctgtcgccttatctgtatttcatccgtccggtttactggatggaaatcaccttgtaatcctggtcctcaacggttttcttcagtaccgaatcatccaccggcgcattcagtgtgaccaccgcgcttcctgattcatggctgacagcggcggcagttacttcgggaagttcctccaggcactttttaacccttgcctcgcagtggccgcacatcataccttcaactttcattgtcttttccatcttttttccttcctttctctttcctttgattttcttatcccttttagcatcatacatcttaaaaagattcagccggagcgcattggtcaccacacagaagctggataagctcatggccgccgccccgaacatgggattcagtttccatccaaagacaggataccacagtcctgctgccaggggaatacccacggcgttgtaaaaaaatgcccagaacaggttctcgtgtatgttccgtaaggtggcgcggcttaagcggatggcggccgggacatcgctaaggcagctcttcataaggaccacatccgccgcatcgatggcaatatcagttcctgctccgatggcaatgccgatatcagccctggtaagcgcaggcgcatcgttaatcccatcccccaccatggctaccctgcccttttgtttcaggctgcggatcacgctttcctttccatccggaagcacgccggcaatcacttcgtccacaccggccagctgtcccacggccctggccgtcctctcattatcgcctgtaagcatgaccacatggattcccatgtccttaagttccttaaccgcctgtgggctgtcttcctttatagtatcggcaactgcgatgattccaatcatccggctgtccatactgaagaacagcggtgtctttccatcttccgccagccgttcggactgggctttcatctcaggcgttaccggcgcctggcttctgatgaagttgaagttgccgccgcacagcacgacgccatccatgacagcggataatccattgccgggcagcgccttaaaatcagatagttccccggcttccagcttctcctcctccgccctgaccataaccgcccttgccagtggatgctcacttctcttctccagggtaaatgcaagttccagaagacgtgtctccgagataccctcagccggtatgatgtcggtcacccttggctctccgtttgtgatggtccctgtcttatccagggccacaatctccattttgcctgcttcctccagggaaacagcggtcttaaacatgatgccgtgtctggcgcccatgccgttgcctaccatgattgccaccggcgtggcaaggcccagggcacaggggcagctgatgaccagcacggaaatcccgcgcgccagggcaaacccgatgccctgccctgcaatcagccatccaatgatggtgaccgccgatatggcaatcacagccggaacaaacacacccgataccttatccgcaaccttggcaatgggggcctttgtagccgccgcatcgctgaccatctggatgatctgggacagagtggtgtcttcccccacccttgaggcctggcacttaatgaagcctgactggttaagggttgccgccgacacgtggtccccctcccccttatccaccgggatgctctccccggtgagggctgattcattcaccgcgctgctgccttccagaacaataccatccacgggtatgttctcccctgggcggaccacaaaaacatccccctttttcacctggtcaatggaaacctctgtctccaccccgtcccttaacagggtggctgtcttcggagccagcttcatcaggctcttcagggcgtccgtggtctttcccttggaacgcgcctccagcatcttgcccacggtaatcagggtcaggatcattgccgcggattcaaaatagaactcatgcatataccccatgaccccggccatatccccgcgcgcctgggcgccagtcatggcgaacagggcatatacgctgtagacaagggaagctcccgaccccagggccaccagcgtatccatgttgggcgccctgtgtatcagccctttgaaaccgttgatgaaaaacttctggttaatcaccatgacaatggctgtcaggatcagctgcagcaatcccatggccacatgattatcagcgaaaaatgccgggaccggccagccccacatcatatgtcccatggaaaaatacatgagtacaatcaagaatcccagggatgcatacaatctctgctttaaaacaggcgtttccctgtcctttaacatatcctccgtatcatgggccgccacattcccggctgccgtgcctttgggttcctctcctttggccgctgccccgtatcctgcgtcctcaaccgcctttacaatgtcctggggggacgcggtcccttccactcccatggagttggtcagcaggctgacggaacacgaggtaacccccggtaccttggataccgctttctccacacgggcgctgcaggcagcgcagctcatgcctgtcactgtatattgttccatatatcttctctccttcctctttgtccataaagcattctccggatggatgcctgcatcagcgcatcagcttctggatagtggccaccagttcgtcaatggtttcatcctttcctgcgcggatatcatccaccacacaggtgcgcatgtgattggccagcagtactttgctgaaactgttcagcgcggcattggccgcagctacctgtaccaggatatccgtacagtaggcatccttttccaccatgttcctgattccgcggatctgtccttcaatacggttcaggcggttcagcagatttttatattcttcttgggaacgctcctttgtcttatggcagcagcattgttctttttccatatccatcctcctcatatacccatatggggtatatctgatgggtttattatataccccatacgggtatattgcaaggactttttattcgtttcattcttttttaggattgggcaaataaaatacatctgcaaaaatcccggctccccatcatatcggttaatgctcctgatgatggcggcggattcctgtagatgtatccttatttatagtacgtataggtctttcatccctgaaccggcatatggatgtccaggtgttctcttaatttcaggcatcctgtttgcggatgcagtccacaagggtcttacagagctgggtgatatccagaggtttgctgacatgggtgtccatcccggctgccagggccgcggagatatcatcattaaaggcattggctgttgtcgcaatgatggggatcgtgagggccagcggatggcccgaggcacggatacgcctggctgcctcatgcccgtccatgaccggcatctgcacatccatcaggatggcatcataatcacctggttttgaagcgaggaaggaatccagcgcctgctgtccatcctccacgcagtccacgtcagccccattcatgcgcagcagtgttgccgcgatttcctgattgagcgcattgtcctcggccatcagcagatggaaaccatccagcggctttccgccgttttttccttccccgtcacaggatgtccctcccttaccccccaaagccgacttgatggcattatagacagaggtacggtaaaggggtttgggaaggaaaccattcactccggccgcccgtgcctcttcttccacttctgaaatatcgtatgccgaaatcatcacgataggaatgtcattgcccacttcccgccggatgcggcgggtcacctcaacgccatccatgtccggcattttccagtcgataaggcataggtcgatatcccggccttcccggtgcatttttttaacatggtcaacggcgtccgcgccggacaggctccactttgcgctgatttttattttttccagcagaaccgcagtctgttcacagacctgctgctcatcgtccacaatgagcgcctggaggccctgttgcgcaaaatcaggctccggcaggcagctcccttcccctttcttaaacggaatatccacaatacaggttgttccaacgccggattcgctttctatctggatctggccgcccatcagcgttatcaggttcctggtaatggacatccccagtcccgtgcctccgtaacgcttcgagatggtggcatcggcctgttcaaacggttggaagattctttccattgcatcttttgtcataccgattccggtatcggagaggatgaagcggagcacatccgccgcattcccgttcctgtggcgggaaacctccaaacggatacagcccccgggcgcggtgaacttcactgcgttggaactgaggtttaaaagaatctggttaagccgcagcgaatcgccgataaagacggtatcctccccgaatccctccatcgtttccctgaactcaatgcctttttcctttgcctgggcgtataccgtggatacgaacccattgacaagctcaaatatatcaaatggttcgtcctgcagaaccattttgctgctctcaatctttgacatatccagcacatcattaatcagcatcagcagatgcttggatgagaaggtgattttggcaagacagtcttccgctttggctgtatccctgattgaggccgccgcaatggtggtcaggccgatgatggcatttaacggcgtgcggatttcatggctcatcctggagaggaattcgcttttcgccatattggccctctcggcggacatcatggcctcctgcagggcctggcgtgagcgtacctcttccgtacggtcggaaaatacggtaatcagctgcggcgtgttcaggtcatccgcccggtagacccggaccagcatccagaatttttccttattcggttttgtatattccaccagtctttcataaggggaactgaagccgggattcctgattccctcccggattgccagggcatcctcctctttcaggcctttataaaagttttctacttccgccatgctgattcccagtatccgttccaggttcagcccgcggtagctgatatatccggtatcggcatcccggatgatgaacgcgtcatcgatgctcagcgatagcttatcaaaaagcttactgcggtaaaccagttccctgcgctgccggtgcagcacatactgggataccaggagcacggcaagcatcattcccatcagtacaatggaaccggtcaggctggtaaccctcagcctttcagcggtgacgccatatcccactttcttggcctgggcaatgcttatgatcttcccggtctgttgaagggcctggtcatagaggggttcaagatgttcctgatcgtaagcctcgatttccttttccgttatatgccggtttgtgcaaaaagccaggtaaccgtcctgctccgcctgtaaatgtaccagggtatccttaagcgcctgcacatcttctgcatcccctagatacagttcctccatccgcgcaaccggttcttccagggagaggaccagttccttcagcttggcgcctgcaatctccacatcctcgctgtcatggtggcgcttcaggcgttcggtgcgcaggcccatttccgatacataaagtttaatatcgccagcagcaatcaccacctcaaacgggtgggttgatatgacctctgtctgatctgccagcttggtggaattcacgatggtcatggccagataacaaaacatcagcagaatcaggattaccgtgctgacaacactcatctgcaggctgcgccctacaaaattcttccgtttcttcttcatcctacgcatcggtcctggctcctcgcttttccgtctttactgggtaacccctaattgtccacatacatatgtatgctaagtatagcaaagaaagatgaaaatagcaatctcttgctgaaagccggaaaaaatcgtggaaacgcagtcccagaaatggtatactacctatataggaaattttacattaacattacaatggaggaaaaagtttggaaaacagcacagaattgcgtacggtcgtttacaatgtcctgcttacccagatacagtttggagtctatcatttccgtgaaaagctccccaccatagaagaaaccagcgcacggctttgcgtatccgtggatacggcgcggtccgcataccttaaactcaaagaaaaaggatatatcaccctgtcgaaaaacgtgggcgccacggttaaagtggattataatgcccaagagacagaggaatatatccaaacttttttttctacacgtaaacatgcaatcattgatttaggccgctccatacagcctctgttttgcaatgcccagtaccttgggctgaaaaatgcttccccggagatgctgacggccatggaagggatttttggagggataaatcagatggcgccttatgccatactgaaacacctcaaccagaaatatgatgcccttggaaataaccttctcatgcgccttgtctggcagtccttcatgtttttacataatccctttttcagcattgcggaaaacaggcagtactttgaccactctcttgattatctgccgaatatcctgcgtatctgccaaaacagggactggaaggcgttgcgcgccgcagtggaacagccggttgaaaacctgtctactgccatttcacggttttacagggacaggattaccatgccagccccggaagaggagatggcttttgcctggagttcctacaaaaaaagccagcagatgtgctactcctttgccatggaactgcttatctcaatcagcaggggaatatatcctgccggaagcattctcccttcccagaaggagcttgccaatcaaaaggggatttcgctgagcacggtccgcagggcacttgaactgctggccagcgtgggggcaatcaaggcttccagatatgtgggcacgcaggtacttccgtttgaaaacgccacggagaacagcgattttaccaaaccggtcctccagcgcaggcttttggatacggctgacagcctccagatgcttgcattatcctgcaaagacgtatccacgctcaccctctcctccctctcccctgattcaatcgaacggatgtgccaggaactgaaggcacagaaaaaggcagggcacggggagaccctgtcttatttcatactgaatctgattgcgcaacacgctccctatcagaccatacgtaccgtttattcagaactgctccgtcagtttttctgggcttacgcgctccggggcatgatggagaaaaaccaggaatccatcaatgccatatacgccccgtatcaggaagcattgaccgcgtctttggaaaaacgggattttgtccggttctccgcccttctggaagagtttatcattgatgaattccacaggaccatggagtccatgtcccagcttcatattccgggaacaaggaacatcctgcttccagactgcccctgattccggactgcttcgggaatccccattccatcccctatcggatccatctttgcagggtctccataagcagtttgacttcaatgggttttgccacatggtcattcatgcccgcgctgtgggcctttccaatatccgtggcaaatgcattggctgtcagcgcaaggatgggaaccgttttggcatcttccctcttcagcgcccgtatggcctcggttgcctcatagccatccatgaccggcatctggatgtccatcaggatgcagtcgtattcacctgacgcggatgcctcgaatttctccactgcagacttcccgttctctgcctcatcgagaacaaggccaaacattatcagcagttccgatgcgatttcccggttaagccggttgtcctccaccagcaggattttcttcccttccagactggaacctgcttccgcggcagggtatgccgctgcgtcagagcgcccgctctggcagaactggtggaaggtgtgggatatcttggacttaaacagtggttttgtaataaaggcgtctgcacctgcccgccggaactcgtcttcaatatcggagtaatcgtaagccgaaatgacaatgacaggaatatccatccccagcttcttcctgattatcttaagggtttcaaggccatccatttccggcatcttccagtccaggattacagaaaagaagtcctcttttgcctcgtgggcttccaccacgcggcacacagcttcccttccgctcagcacccagctgctatgcatgcccagctcgtccaggatttctgctgcactctcacagatgatctggtcatcgtccaccaccagcactggcaggccggtcaactcccccaggtcatcctccgcctcttcacacagttcaaaagaaacagccacaatgaaacggctcccctgtccaggattgctcctgacctcaatggtgccattcatcatccgcacgatattctgtgtgattgccatgccaagccctgtaccctgtacctgattgattgtaggatcctttgcacgggcaaagggttcaaaaacatgaggaaggaactcttcagacatcccgataccattgtcagtgacaatgaattcatactgtccccgtcctttggcaaaagacggcacttcccggatccataatcccacacatccgccatcaggagtatatttaactgcattggagagaaggttaaccagcacctgacgcaggcggttctgatctgttatcacgttctcatgccgcacatggtcggcgttaacctgcagctcctgatgcttttccgcagccaggggacggaatacatccataacatcttcaatcagttccggcagtgagattgtctcggagataagatcaatcttcccgctttcgattttcgacatatccaggacctcattgatgaggctcaggagatgccggctggaaacattaatcttgttcaggcagtcctgtatcttttccggggacttaaggtttgcctgggcaatgaccgacataccgatgatggcgttcatgggcgtacggatatcgtgggacatggaggaaaggaagttggtcttggcatcattggcaatctgcgcagtcttgcatgcatcttcaagggcctgcttctgccgggcctgctccctgcgctccgccgtcacatcaacgcctacactgtaataggaaggaaccccatcccagctcttgtcttcgctgacatagctgtaggttaccatcaggatcttaacggtaccgtcatgggtcacgatacggatttccgcagccgtggccccgcctgttatcctggactgctccatgacaccggctatgcgctcaatgtcatccgggtgaatgtagtcacattgggaacacagctcctcctcaaattgttcttctgtataaccgatcagttccaggaaaccgccgctgtaccacaggacggtctgcatatcgcggccatctatcctggccaatccgcccgggatgctgcgaatcagcgcctctctttcctgatcctttttggccagcttatattccgtactgtacatgtcatgggaaagttcaagccgcgccctgtgccccttccaatcgatgatccggttcttaatccagaacgtctgttccaggaccgggttttgaaattcccactcgtagaagtcatcctcagtcagtctgttattggtacagaaggggcagggagttgtcctgccctgtatcacctcatagcacttccgtccaaccagcttaacggcaggcattcccagcacatcacaggaatgctggttcacatacagcaactcatagtcatccatatcgcttacataaacattaccctcgtatgtatccagcatccaatggaaatactgcagtttctgccggtaaagccgttcctgctcctctttcacggcaaccagcgtatccacgcccgcaaactcggcctgcagcaccggcgctcctgttgcagggtctatccggatggttccgctaagattggcccaggcatgtcccccctctctctgaggcagacgtacggtcatcccgatatcgcatcttccaccctcatccgccttcgtcaattcactgcgaatcaactcaaactcatccggcagcgccgcatagtattgccgcaggctgcaaaaactgctgtggaaactttccctggaatgaccgatactgctgaaaaaaccggaattcccccactggaatgtcatgtccttatccagaaaacaacagataataccagttttcagcatatccagcgcggccggacagctcccccctgcatcctgaaacaataaatccccgctttgccctgccaagtttaccatgattcaaccacctattcctgatctgatatatcgaattgctttttactatccctatacctatatccaaacactgccaattgacaaagcagttaattgttcacatacatatatgttcttcagtataacaaaagcagtcgaaaatagcaatagcgcggcccgatttacaagggatgttcccaaaaaaccggaacagaagccatttcagcgccgtcaagccgcatcacataaggctggttccagtaaaacgccgcgccatggaacttcagcgttacttcagtgtcgccttcgtcataataaatatggaagccgctgagattacccttcccgtcaaagtcatactgctcacgctcccatcctcccctgcttaacttccgttggcagagcaggccttttaatgtaaggtccctgtcttcatgcactgccgtcacattgatgtatacctccggtctgcccaccgctttaacttcatctctttcaccccctgtttccgccggacggggttccttcaaccttgcaatgccaaggatacgcacagaaccgtcctgccagggaatgagttcgtttaatccttcccggtcctccgggataggcagcgtgacaggcgcggattcctcacggttcaagaacgtgattccgggaatattaatctggaaagacccatcctgctcttcctgtggaacatcgaacaggcatctggtacgccgtccatattgtctcacatctgacagccggtagtggccaagattgtcccaatagggattggcagacaattccctgattgcatactgtttcccgttgccggatatggttggcaggtccatatccagggaaggcggtttatatgcaatgcttatgggcgtttccccagcttcactgtatacataccaggatatgaggattccctcccttaccttttcccccatgcttatgatagaaaaaaatatgcggtcccgggggaatcccccaaagaccgcatattgactggcttttcacagaattttaatttgtctggaattaatcctcaacgcttacaatttctctcttgttataagaaccacaagccttgcaaactctgtgaggcatcatcagggcgccacacttgctgcactttaccagatttggagcgctcatcttccagtttgccctgcggctgtctcttcttgctttagaagatttattctttggacagatagacatggtttacacctccttcaactgtttaaaaatatcctggataactgacattcttgggtccagtgggccgtcttcacagtcaccttccccagagcccggatttgtaccatatctattagaaattcccttacagtcttcactgcagagaaccttcataggcaggttcaaggttaactcgttaccaaccagctggtcgacatccagattataaccattaatatagaactgttcatccaaatcagctgccctttcctcatccgtctgcttcatgtccactttctggtcaatctccagatggaatggaacctttaccggctcaaggcatcggctgcacggcatctcaagacacacatcagcttcacctgtcacggtcagcaccttatccccctggttggtaatcaccagggtaacgggatgcttctccacaacctcataaacaccatccgatgcatgaaactgcgtcatctccaattccagggtatatgttttagattttccctcaacgggaaacagttccgataaattaatcagcatatcatactccttgatatgcacctatgctattatacataggcgcaaggggtttgtcaataaaaagtttccaaaattacgcaaatttatatggaaatttactgaacaagttccagggtctctcttgcaattgccagctcttcgttggtcggaatcagcattacctttaccttggaatcagcagcggaaatcaccctctcctcgccgcgtacattattggcctcatcgtcaatcttaacgcccatgtaagccaggttggagcagattgcctttcttccggtcttgtcattctcaccaacacctgctgtaaatgcaattgcatccacgccgttcattgcagcagcatatgcaccgatgtacttggtcacacggtagatgaatgcatccagcgcaacctctgccagatggttcccgtcagccttggcgttttcaatgtcgcggaagtcgctggagattccgttggtcatgccgtaaacgccggacttcttatttaagatatccagcatctcgttgatatcgatgccttccttgttcatgatgaactgaagcacagccgggtccacatcaccgcttctggttcccatgatcagaccttcaagaggtgttaagcccatgctggtgtccacgcacttgccgccgatggaagcagatacgctggcgccgttgcccaggtggcatacaatgacttttgcagtctcaggatccaggccgccgaacctgattgcctcgccggacacgaacttatggctggttccgtggaagccatagcggcggatgccgtacttctcaaagtactcgtggggaattgcatacatataagccttctctggcatggacataccaaatgcagtatcaaacacagcaacgttaggcgttccgggcatggctgcctcgcaggcctcgatacccatcaggttggctggattgtgcagggggcccaggtcgaagcattcacggatgaccctcttcacatcttcattgacaacgatggaatcactgtaaacagtaccgccgtgaagtacacggtgtccaatggcggaaatctcgcttgtatccttaatcacgccatggtccgcatcctgaagggcttccatgaccatctcaattgccgtcttatgggtaggcatcggtttctcaataatgaacttgtccttcccggccggctgatgtgtcagcttggagccttcaatcccaatcctctcgcagaggccctttgccactacgctttcattctccatatcgattaactgatactttaaggaagagctgccgcagttaataactaaaatcttcatatttgtaatttctccttaatattattaattattctggcactgtacagcggtaatggccacaacgcctacgatatcatctgcagagcagcctctggacagatcgttaacaggctttgcaatgccctggcacatgggaccgtaggcctctgccttgccaagcctctgcaccagcttgtagccgatgttgcctgcatccaggtccgggaataccagtacattggcatgtccggccaccttgctgcccggtgccttggactcgccgatttcaggaacaatggctgcatccagctggagttcgccgtccagttccagctcaggagccatctccttggccagtctggttgcctcaaccaccttgtccacgtccgcgtggcttgcgctgcccttggaggaatgggaaagcatcgcaaccttggcatcccttcccgtaagcagcttaaagctctcagcagaggatactgcaatggcagccagctcttccgggttcgggttctggttcagaccgcagtcagcaaatacaaaggttccgttgtccccgaactggcagtcgggaacttccataaggaagaatgcggataccagcttggtgcctggcttggtcttgatgacctggaggcaggggcgcagtgtattggcagtggagtggcaggcgccggataccatgccgtcggcatcgcccttcttaatcatcaggcagccgtagtatgcataatcgttcaggatggtttccctggccttttcctcggtcattcctttggctttcctcagttccacgaataaatcaatatattcctgtgtcttctcatatgtctgcggattgatgatggttgctccggacacatccagtcccttgctgtgctcgccgatatcctccggtgttccgataatgaccagatttgccagatcctcttttaaaatcttttcagcagcaacccatgtcctgcggtccatagactccggaagaacaatggtcttcttatctgctcttgctttttctttaataacatcaataaatcccatggtatacccctttccttattgtaaataatgcatataggcttattatatacgttgtgaatgggggaaacaagttgtatttcacaaattcttgcatttttttaagtaccctgcataagtatatttattggattatctatattatatccaaataaaaagagatgacacctgccatctcctttcttttaaccgctatcctgcccggtaaaccttattccatctttatcagccgtccgtctcaaggtgcccgggtcctgccgttgtctcgccttccacaaagtccagctgcaccagctgggatttaaaatgctgcttggggttatcgatattccggagaagctttttgaaggcaacgcccaccacatcggctatctgcgtggggctgttggtatacttaagacccagcgtgccgttattctggtagttcaggacaatgacggataactcttccggtatccttatatggaacttgggaaccgcacgctctatgattcccagcgctgactgtaccacgatgacagccgttgggcgccgcgggctgttccagagatgttcaaacctccggctgtcagcttcccttccctcttctgttatataatcgctttccatgatgtaatccggttcaaaaggaagccctgcctcccttaccgcctcctcgtacgctgacaggcggacatcgtacacgatattacccaggccctctgctatgaggagtattttcctgtgtcccaggccggccagatacatgactgcttcttttgtcacctttccatggtcggaagccacgtagtggtagtcctccatattacggtatttgccgatacagacatatgggatctgttctgcttcaaaacactggaagtaagggtctgattcccttaagtcataacagatgaacccatcgatgatggaggccgacatgcctctgataaaatcaatttctttctgtatgtcatgcatggtacggacgtataccaggatatggtactcctttttcattgccaggctgctcagggcatggatcatggccccataaccattgtcatacaatccattattaaataacagggtcggcactatgacacagaccgtctgccccttcccttttgaggaaagcctcctggcgcttaaggacgggacataatcaagtctggcaatggcctgttcaatcttttctttcgtggggccggacattgtatggaaacggccattcagataattcgatacggttgatgtggaaacgcctgctgcctctgcgacatcggctattttagcttttttcacatgaactcctttctggcaccggcagcccatcctgccgggtaaattacattatttcttattatataatgtcctgcgccggaattcaacgtttcaaatcatattcccacatccattttccaatcccggatgctttaaagaagactgtcccggtcagccatcctggcgcagaccggcgacggtatcctgatttcctccacgacttcccctaaaagcccgtcctgcgcattcctcctgaagattaccagattaccggaatcctggttcgctgccacgatataccgcccgcagggtgaaaggcagaaattccttggactctttcccccgcacagctggaacctgcatgttcccagaagtcctgtctccctgtccacctgaaacacgctgatgatatccgcgccccgctccgagacatacagatacctgccatcggatgacatatggatgtcggccgcaagattgaaccccgtgtaggaagccggcagggacgggaccttctggacaaaggtaaggttcccgtcctcactgttatattgatagcagaaaacactgcccttcagctccgtgaccaggtacaggtaccttccatccggtgaaaaacacatatggcggggtccttcccccggaccgacataggtttcaggacaggcttcacagggaaccggtccctggctggcttcatcccatctgtaatgatacagccggtccgtccccaggtccgccacaaagagggtcttcccatccggcgacaggatggacgagtgggcatggggaccctcctggcgcacagggtcctccccccttccttcatattggaaaaaaccgttcctggctccgatgaatccgtccggcagcagcgcatggtttaccatgctcccggacaggtaattggttattacaaggcagttcttttccttccagataaggacatggcaggcagccgaacccgggatgggcatctcattgacataggtaaacctgccctggcccgcatcataccggagggccgtgacgcagccgccctccgccatctcgctgacagcatacagcatattgccggatacggccaggaaggaagggttgcggcacccttcatagatggaacacagcctggccctttgggtttcatcgtcaaattcaaaggcataaatcccctgcccgtccgtgccgcgtctttcaccagactccacatcacatgtataagtccccacccataaacaagtcttcatcgatgccttacctcctaaaccgtaatgagttcatattccctgcttcccaggcccagcttaaccgcatggtcaatggcaaccttccagttggtatcgggatgggtatccgtaaaatggtccccatggcaatggtttctgccggacagcacgctgccctctattacgggctgacggtttaccgcgtcggcacacgccaggtccagggctaccgggtcaaaggaagcgaacatgcccacgtttgggacaatggggatatcattttccgagtggcagtcacagtatggcgacacatcaaccacaaggcttacatggaaatgcggacggccctgaagcacggccagcgcatattccgctatcttcttgttcaggatgtcattggcctcattgttatccgcagccaccgcgtccatgggacaggttccgatgcatctgccgcatccggcgcacactgcggtgtcaatggaagctttaccggattccagggttattgcaccatgggcgcactgccggacgcaggccccgcatccgacgcagagtcccgcatccacatggggcttgccggagttatgcatctccatcttgcctgccctggagccgcagcccattccgatgttcttaagggcgccgccaaagcctgccgcctcatggcccttgaaatgggtcagggatatgatgatatccgcgtccatgacagcccttcctatcttggcttcccggacatactccccatccacgggcacaaggatatcgtccgtaccttttaacccgtcgccgatgattacatggcagcccgtggcaaatggattatagccatcctcatacgcactgtccagatggtccagggcatttttcctccggcccacatacagggtattacagtccgtgaggaaaaccctgccgccctgtgaacggatcaggtccaccagcacctttgaatagttgggacggagataggccagatttcccggctccccgaaatgaagcttaatggcagtgtatttattggaaaaatcaatctgctccagcattcccgcctgtttcacaagtcttgccagcttctgcagcaggttctcgctcagcgttgtatgcatattggtataataaactttagacatccatatatcctcctatgccagaattgttcctgaatcagcccttatggctgtgccgtggatcatttccgcctcgtcggaggcaagaaatgccacaacatgggccgcgtcctttggctcgttgatacggtcagccaggctcagctttgaaaacggaaacagacgctcctcatcagccaggccgctttccaccacgtccctgggcttgccggatttaaccccgatatcgacataaccatattccacggaattaacattaatgtggtaatccgccagttccagggcgctttccctggtcagcatcttgatggccccttttgtcatgctgtagcccgggtcaaagttggtgggccgtttcgcatggaccgaggaaatgttaatgatcttgccatatctcttttccttcatataaggcagcacgccctgcatacacaggatatagccgtacaggttcgtatggaaaatcctggaaagatgctggtcatcatactcatcaaaggggatattacactggtatgccgcattgttgaccaggatgtcaataccgccgaatgcatccattccctgcgcaatcatggaatccacctgcgctttatccgtcacgtccgcctgcaccgcaatgcactttgcccccaggctgttcagtttttcacatatggcctttccgtcagacgatgtatgataattgacaatcacgttagcgccgcatctggccagttccatggagattccttccccgattcctttggcccctcctgttaccagcgctgttttaccctttaaatcaaacatacgtatccctaccctctcatcaatcccctgtggtttgctttttcgtcaatataatgcagcagcagtccgccgtccatgcgtatttccgtgccatttacataccggcagcggctatccaacagaaagccgcacagctgggcggtatcggacgcgctccccaccgtaccggacggtatcttgtactggtatccctcatataaggtggtgtaactgcttttgggggcaaataccgcctctttaatggggccaagttcaatgaatactgaggatacatttttcacccccaggcccagggccgcttccctggacaggttcttcaccgctcccattgccatggagaaaagcggataggccccagacggcttatcatcatggatggagccgatgaagatgagcttaccgttcatctcccggtccatggcagcgccgaatacctgggcagccgtcatgggggattggatgttttccttatagtttttctcaaactgttcctctgtaagatttgaaaccgaaccttccaccactgtaaaataattataaatcaccccataggccggcccaagggcctcctccgcctccctgacagcctgttttaaggcctccctgtcagaaagccctgcatccgtaaccatataggctgcatggcaggtgtccagctcttcttttaaagcctggtccatgggttccccgtgcatgaatataaggataccggccttctccctgcagagcatggtgatgcattccctgccaacggccgtccttccatcagtcacagcaaccattttatgttctaatcccataacacactcctcttttcatcagctccacagcctgtcgctggaatattcacggtcccactgcccggtaggcgcccagatttcaggatgcccgggccatgtatgctggcggattacctcgtcattaaagccttcggccccaagaccgggagcttccggcacatgcagatacccgtcccggattaacggctcaggaaggcctgtcaccaggtcctgccagtaatcgtcatccggcgcattgaactccatggcaatgaagttctctgttgccagtcccacatgcccggttgccagggccgccaccggcgtctcacacatgtgcatcgccatagccgtatggtacttctgggccatattcccaatctgcttgcattccaggatcccgcctgcggaacagatgtccggatggatgacggccacgccgcccggtgcgcacagtgcctcataattttccacataggtaaggtcctccccgcatgccagcggggttgatgtgtaatcacggagcgccctgtattcctgtgccatggtgcatggaaggacgtcctcgcaccacatcaggttgtatttctcaaggcgtcttaacagccgtttggcgtcatccagtcccagatgacccagatggtcgatggcgattggcaccctgtatcccagttcttcccttatctgggccacatgttcctcgtagcggtcaaggccccgttccgttggacgtatgaaggtatagggatgctgcaccatgccgtaatcctccatcctccgcttaaacggcttatcatctatgtccgccagtcctgtcaccggatcctccttcagcaggttctcatggcctgccaggatctggtcaatgtaatcctgaggccctgacagaagttcttcgtccgggtacaggtactggatttcttccatgcccacgattactttacacatcttcatcccgaaccggtccatgcgctccctgatggccctggctttcagggttccgttcaccctttgggaaggcggggtccggccaaggtcgcagtacaccctgacctgttccctgaaccgtcctcccagcatcctgtacaccgggacaccgtatgccttgccggccaggtcccataaggccatctcaatcccactgacgcccccgccctgcctggaaggaccgccgaactgttttatcttgcggaacagacggtccacatcacacgggttttcgcctatgagcctgctttttaacatggcggcataggtggcgctggccccgtcccgcacctcccccattcccaccaggccctggtccgtgtctatcttcaccaggatgcagtgcatggatgaggcttttacatgggcaaacctgatatccgttatcttcagtccgcctggggcggagcaggtattgatgcggccctgcaggcattcgttcatactctccattttaattccaatcccctttctattctgcaagcgctgcctgcatcacacggtcctgggtaatctcctcgttgttgaattcacctgtaatccggccattgctgagcacgatacagcggtcgctcatggatatcagctccggcatgtcggagctgaccatgacgattgcaacgccctgttccgtcagttcattcatgattttatagatttccgtcttggcgcccacatcgattcccttggtaggctcgtcgatgaataatatctgcggttcctccaaaagccattttcccagcaccaccttctgctggttgccgcctgaaaggttcacgattacggtctcaatggacggggcttttacgcggagccggtcaaacatcttcttgacccattgtttttcgtactttttatcgataaagcagccttttgatatattcttaaggctggccagggacaggttttccctgatggtgaatacccagacaaaaccggatttcttcctctcctccgtcacaaaaccgattccattgcggatggcgtcgccggggcagttgatttcaaccttctttccgccgatgtacacctgtttcttcacgccttttgtgatctgcccaaagacagcgcccagcatctcgcttctccccgctcccaccaggccgccgattccaaggatttcgcctttcctcacatgaaagcctacattttcaactatgttcttattcttcatcgtcggatgggggacggacaggttctccacgcgcaggatttcctcgccgattcttgccttttctttgggatacatgttttcgatggtacggcccaccatctcctcaaccagctgcttctcacagacacttcctatctcgcggcaggatatgaaggccccgtcacgcatgaccaccacccggtccgctatccggaagacctcgtccagacgatgggaaatgaacaggcaggaaacgccacgtttcctcagatcgtccatcagcttcatcaacagctcggtttcctggtccgtaagcgcgctggtgggttcgtccagcaccatgatcctgggattcctgctgagggccctcatgatggacagcatctgcatctggccgctgttcaggcttctggcctttgtgtccggttcaatatccagtccgatatcatccagtatcttcctggtgtccgcatagagcctgcggtaattgacaaagccgtttttgccgggaaggtttcccacaaaaacattttccgctatggtggcatccagcatcatgttcatctcctggtagaccatctcaatcccatagcgctcggctgaggccacagaggtcatctccgccggtttgccgtcgatgaggatttccccttcatactccccggccacgtagcttccgctcaggaccttcataagggtggatttccctgcgccgttttccccgcacactgccaggatttcccctttcctcagctcgatggatacatctttcagcgcgattacaccgggaaaacgctttgtaaccttacgcatctccaatatcgtttcgcccatatgtatgcctcctttcccttactctgcgcctcctgctttcctgcggtacttgtcaatgaatatggcggcaagaagaatcacgccgaatatcaggttctgccagaacgtggataccttcattacaatcagggcattggtgatggtggccagcaggatacagccaagggccgaccccaggacggtcccggtaccgccaaacatgcttgtgccgccaatgatgaccgaagccatgattgtcagctcggtgcctgttccggctgccggctgtgcgctggcaaaacgggaagccatcagcacgccggataaggctgcaagcatggaggtggcgatgaaaaccgtcaggcacttggcgcgtacgttgatgcctgcaagataggcagtctccctgtttccgccgatggccaggatggcgcggccgtacttggtctttaccagtatgatatgtccgatgataccgatgatcagcgcatagacaacaggcagagggaccatcccgaacagtttattctgtcctatcatcttaaaactgctggaaaaaccggatattgccaggttttccgtggtgattgcgatgattccgttaaacgcatactgggtacccaaggtggcgatgaatggaggcaggtcaaaatacacgattacaatgccgttgatgacccccaccactgcgccggccccaagggccagcacaatggaaaccgggatcggcattcctgccttcagtgcaaaggcgcagacaacacctccgaaactggtggcggcgcctatggaaagatccattccgccggaagccatcagaaatgtgataggtacggcgacaataaacgaaaagctggatgtcttcagtatatcaaggatgttgttcattgcaaagaagttgggattcacacagcccaccacaatcagcagaagacacagaggcaggattgtccctaattcgtttttgtttaaaagcgcatgtaggaccgcacttttcttaacctgggcattatccggttgtttttccattttccttctcctttccggcgcagccgccgcagccagcctactcacccatgtcaatgccgcgttcttttacccagccgtcaatatcgtcgatgaacagggttgttgttcctgagtcattgccgcgctcgtactgcccgccgtcacggaccgccttggccagatatgccccgtcatatcccacgttgtaccagtgctgtgctaccgtacataccatgctgccgtcctgcacgcatcttaagatttcaggcgcatcatcaatccccaccacgcagaagctgtcctgaagcccgttctcctgtacgaaggcagcgcctccaaggcctgcatagctgtcaaaggaaaccatgcagttgatatccgggtccgccagataggaggcagatatcttatcctgtgccgtggctgcattggacatacactccgtcttatccgccacaatggcatccggcctcagttccttcagtttttcctcaaatgcagccacctggtcattctgctgttccatggtcaggttgctctgcatggtgagcaccttaatgggtttgtcgcccatggcctggatcagggcctctgcaacggagtatcccaggttaaccgggtcagtgcctatgtatgccgcgggaatatcattatccgtggcaataccgatcagggttacgccctgctctaccgcgcggttcatgacatcctctgcagcgtcctcctgggtcagcacgatcaatatgatgtccgccccattggtcagggctgtttccgtattattgaccatgtcctgggtattacccggtgtctggggcgccaggtagtggccctcccacccaagctcggcacacgcgtcattgaatcctttttccgcctggccccatgcagctccccctgccatcccgctgctgaaatatacaaccagcttatcctcaccgctgctttcagcctgtgctgcggatgtgcctgtctgttctgccgccgttgtatctgcttttgtggttccctgacatccggtaagcatggctgccgctgtcatggttgctgccaataataatgtacctatctgttttctgtaaaccttatttccccgcttcatgttattcctcctcatatacaatctgctaacatgtaccttccattataaacggtatttctttttacagcaccccaaattctgcatatacctggtcaatgggcattccgtccgccagcatctgacgctgcttattctctttttcatagattgcctccaccctgagaagcacttcatccacgatatccttcgggattacctgcacgccgtcattatccccaaatatgaaatcccccggataaatggttacgtaatgagtgacatggccgggcagcatggccgggacattgacatcggtgacaatccatccgccgaacgcgttaggcgcagtcccaaaggaatacattgggaaatcctgcattttcagcacatactgcgtatccctgcagttccctgcaagaagcattccgcggcatccgtgggcataggccagctggcagctcatttccccaaaatgagcgggctgcatatcccctccgcagtcaaaacataagatgctcccatccggctcagaggcaaccgtgcgcatcatgattttctgtggatgctcccggccgtccagatagtcctcatagaacttatccagtgattcgcccggaaggtaggaagtgtcaatggacagggtatggagtttgaccggcagggcgcggcccaccagctgcattccctggcgaagcgccttaaaacgctgcgacaggactgtgtcgcacacgccaagggaccagagtgagtcggaaacattgccgccgtacccggctttcttaaaacgttcaatgcgctccaggtccgtgatgtccagatggcggatttcctctcttggtatggtgtactccctgttttctggtaacataatcgtattcctcctttatatttttatttgatatgatgctcagctccacagacggtcgtggctgtagctgttattccagtcatcggtagcctcccaaaggccggggattttctcattgtcaatatgttcccgtatcacatcgtccaccagtccttcaattcccaatccgggggcatccggtactttgatatatccgttctgtatcaggggtttcctggttccgatgaccaaatcatcccaccatggaacatcgttggaatggaactccagggccaggaagttctctgtggcggctacgctgtgcacggcagccagacaggccacaggactctccgccatatgtacggccatggccaccccgtattcttgggccatgtcgccgattttcttgttctccaggatcccgccggatgtgagcaggtccggatgtatgacagaaacgccgcctgcctccagaaggggacggaagccttccttcagatagatatcctcgcccgtgcatatggggacattgacggactgctttaagatggcgtactgtttcgtataatgccagggcagcgcgtcctccagccaggcaatattgtatttctccagcatcctgcccagcttgatgcactcggtcaggccgatatgtccgatatggtcgattgccaggggaatctcatagccgatgacagagcgcacatccgacatgtactggtccagatattccaggcccttctgcgtaatctgcacagcggtcatcccatgttcgatgttctggacttccctgacacggttcatgtgataccgctcatccagggtcccctgcttccacatgatttcatcacagtcctctgcttccctgagcttatcaatgaatcccaggggagcgctgagggcgcccggcacgtcgtacaaaaggctgatgctcaggtccatcttaagcatggtaaagcctttttccatccttttttttagggcctcacccatcttcttcccgctgtttttcccttccacatccgtgtcacagtagcagcggatctcatccctgaatttgccgcccagcatctggtacaccggtaccccatatgccttgccggccagatcccacagggcaagctcgattccgcagaccccgcctgcctggcgtgacagtcctccgaactgtttcatcttgcggaagatgcggtccacattacaggggttctcgccaatcagcttgcttttcagcatcagcgcatagcgcttatccgcaaagtccctgacctccccgtatcccaccagtccctggttggtgaacaccttaaccaggatacagtgcatgggggcattccagatatctgcaaagcggatatccgtaatcctcagttccgacggcgaggagcatgtctttacattgtttaagacctcgcctgcttccattctctctttcattgctgtccctcctagattatatgatttttgtatttactgttaattttttcctattgattgttaattatttagtgttttattataataaatcggtttagtaaatcggtttgtattatatatagcacctaatgtcagttatgtcaatacctctttgaacattttcactaagaaacctctttttaattcctttttattgtctgaaaatgcatttagagggcgcgaatgatattataaacaggaatccttgtgtttctgcatcaaaaaaaggcatctgcaattgatacgatatgccccttgtctgcaggacaaggggcatatcgtatagcgcagatacctctttcataccgttaagtttgtttttggcaattcatctcaccaccttagaggatgggagaaaccttgctaatttttgttaaattttctcgtaccggtccacatcaattacaaagattgtggcgccgcccacttccacgttcatgggcatggttgcgtagttcaccatggtggttccggaaatatatggcatattcaccgtaagcttctggtgctgcccgcactcctgcttaatgatatcaatcacttcctgtaccttatcatcctccgcaccgatcatcagtgtggtattgccctttttcaggaatccgccggtggtggacagcctggttacgctgtagtgctgttgggttaactggcttactacgtcatcttcgttgtcgttccttacgattgcatatactaatttcataagctgaacctccttaattgattgtctattaggtccagtatatcatattttccataaaataggtgttaatattttatgaattagctgccggctttgttcccagggttatctgtatatcatgctccacgtaagcgccgttgaccagggactggacggtcagggtaatggtggatccgccctcataatacgtaagcatctgttttaattcttccatgttcgtaacagactgtccgtcaaacttagtaatgatatccttttcctttaaatcagaggatgcggctgccccgccttccacgatcttatagacatagatgcctaccggcatgccgaattcctgtgccgcggatgcgtcaatgttggttccctggatacccagatacccctgggcgccctcagatacggccacacgggtcttcttggtcatcaggctgtttaagatatcctgcgccttggagatggggattgcaaagcccatgccctcaacctccgtggaagctgtcttggccgcattgataccgattacattgccgtttaagtcaatcagggcgccgccgctgttgcctgggttgatggctgcatcggtctggatgaaggtccttgtgattccgctgccgtccgtgatttccctgtcaagtgcgctgacatagccgacagttacggactgtccatatccaagtgcgtttccgattgccaccacctgctggcctacctttatgttgtcggaatctcccagggaagccaccttaatcttgctcatggtgtcggacgggatatcctttaactggactgcgatgattgccaggtcagaggcggaatccgtacccttgacagcagcgcttacgtcgttgttgtcaacaaatgtaaccttcaaatcctgcgccccgtcaaccacatgattgttggtggcaatcagcagctccgtatcgctctggttgatgatgatgcctgaaccgctgctctgggcctggtaggtctgtggcattccgaagaagtcccgctgctgaacggtcatggtatcattgatggccacaatggacggcatcactgtttccacgattcctgacacatcggtgaccgcggtcaccgtggtcgctccctgtccgccgttctgcgtggtcacggcgggcgccacctgctggatctgcggctggacctgtgcctgtgcctgggcgcctgcattgccgtacatgcctgtcatcctggctcccagataattaacgcctgtcatcaccccgccggatacggcgccgaacaggaccgccgctgccgtgattccggctgcccgtttcatccacatgcctttctttggttcccggttcccgccgctgccgctgttcccggactgctgtgaatacacattgtatccctgctggcggctgccttcatgggatggattgaatccgctgttcctgtttccctggccctcatccatattgggggtggtccagttaacggttgtctccggtatgttcctttccggtatgttcctctctgtgctgttatctccatttaaattcctgttttcattcccgtacataaaaaagtctcctttcatacaattctctatgttttggatatttcatctatttccttttgacagttataaatatacccttgatttatggtggaattgtgaagcgattgtggagaaattgtgttcgaaatattatagatttataaactggaaataaacggatccagggcaggcggggccggaccggacgattcaggctggacggattgactgattcccgatataatggacatgataatttgcagagagaaagaacgaggtattccatgagactgaccggaatcatagcagaatataatcccttccacagcggacatgaatttcatattaaaaaagcaaaggaactgacagactccggcttctgcgtggttgtcatgagcggcgactttgtgcagcgcggggaacctgcgctttatagcaaatatctgcggacccgcatggccctgtgctgcggcgcggacctggtggtggaactgccctccgcctttgccgtcagcagcgctgaggattttgcggcctgcggcgtgtccctccttactgcccttggcgccgtggataccatatgctttggcagtgaggacgggcaggtccggccaatcctgacagccgcctccctgctggccgaggaaagcccggccttctccggactcctggaccaggggctgagacagggcttaagctggccccaggccaggaaccatgccctgatccagatggcagggaccgtgccggactttcccctgcagcctgaaagcctggaccgtcttcttggctcccccaacaacctgctggggattgaatactgcaaagccatcatccgcagtaacagcaacctgaagcctgtgaccatcaaacgcatgggccagggctaccacgacagggaactggaccagggccaggcttctgcgtccgccctgaggcgcctgctgacagaaggcaatgcacacacggacccgttatccagcctttcctcccgtctctcagcccatgtgcccccggctgtcctgtccatgtatggtacggaaccggccgtgggggtgaatgacctttcagggctgctgaactacacactgcttaccatggccagccaggagattgatttttcctcttatgcggatgtgtcaaaggagatggcttccaggctgaggacgcggcttcttgaatacgaaaactgggaaggacggatccgtcagctcaagacgcgccagtatacctatacaaggatcagccgcgccctgctccacatccttttaggcatgacagaccaggatatggcccaatataaaagcgcagggtatgcaccctacgcccgtatactcggttttaaaaaggattcagcagggctgctctccatgataaagaagcagtcctccatcccgctgatcacaaagacggccgacgccccgcgcatcctcacgggcacctccctcagcatgctgaaaaaggatatctatgccacccatatccgccaggccatcctggcccacgcctatgggtacaggtgccgcaatgaatacacccagcccgtatgcatcatctagtgcatcatttaatacatcatctggtgcatcatctggtgcatcctctaatgctccatccaaagttccggagccagcagcttcacaatggcaggcgtcacccccaggaaccccagcagttcttttaactgcccttcattcccggccttcttcccctggcggatgcccctgataaggatattcttaggcgtgtgttccatatcgataaattccagtatctgggtcctgtatccgcagcgttccagcacctgcgcacgtatggcgtcggtgtacagggccgccatcctttccttaatcagaccatactgcagtaccggcttctgtatgtcacagcttatctgctttgccagttcatgctggcagcagggcacggacaggattaccttcgcaccccagttcactgcctttgccagcgcatggtcagtggccgtgtcacaggcgtgcagggtcaccaccatatccacatggtccacgccctcataggaagcgatatccccgtgatagaaatccagcctgtcatatccgtactgcctggcaagacggttgcagtggtctatcacatcctgcttcaggtccagcccgatgatgcgcaccgggtattccttcagcaccttcaggtaatagtacatggcaaaggtaagataggacttgccgcatccaaagtcaatgatggttgtctcctcttcctgatttaaattggggaggatgtcctcaatgaactccaggaaacggttaatctggcggtacttatcataccggctgttaacaatcttcccttcccttgtcatgacccccaggtccaccaggaacgggacggcacagccctccttaaggatatagcgtttctggcggttatgggacataagcccggatgcaggctgtatacgggcgggctgggcctccgctcccccgctgtgcgccttcctctttaccttgaccgtgacctttcccttcctgctcacaagaatcagcccggtcccatggcctgacacaatctctgcctgcctgaagcttccgtccagcagttccctgatataggacagggcctcctcccgggacaggttgcggtggaatgcctgtctgcccacctgctcctctgcctggaacaccaggctgcctttcatgagcagcggacgcagcctggatttagcaatccgttcccggtccaccgggttgctgaaaagtatccgctccagggcctcgtccaggaacaggtccaaagcctgtcctaattccctgcattcttcctgatccatatatccactcctaacctaacatctgccttgcggttccgggcagctgttccattgattcaatgatgccttccggcgcatccgcggtgccatagccatatgcggcatggacaaagggaacccctgccatggctgccgcttcctggtccatggacgtatcccccacatagatacacttatccagatggttcctctggaccaccatccgtatattgtcgcccttgggcaggcccgtattgccgaagcattccgtatcccttatgtattccccaaggccgcagcttttaagaagcacctcaatataaccgcactggcagttgcttacaatgaacagttcatagtcccgggccagccggatgattgtctcctttacccccggatacaagattccgggatgtgtctcaagataccggttctcgtactccatgcactctttcatgaacctggtccgctcctcatgggaaaaggaagggaagaaagcccggcccagctcatccatggtctttcccatgttattgttcatgtcctctaccgttatggtcacattcagtcccggatgcatggacaatacctcattccaggaatccaccacctggaccgccgcatcccacagtgtcccatccacatcaaatatgataccctttttcattcctgcccctctctcatcacagcattaattttcagtacccacccatgcccttctgagaaggtcggggcaggcttccaaatgcgcgtaatcattaaaccgttccagtaaaaaacggctgttctcctcatcccagtccagctgggttatactgcagttctcaaggctggcgcccagaatcctccacctagccatgggtatgcccaggtaatgggcaaccatggagcggatgacgccgccgtgggtcaccacggcaatcctgtcgtatccgctgtggaccatttccataaaaacaggttctgcccggcgcaccacatccgcagcgcattcgccgcccgggtacggcaggtcctcctccatccggccctgctgcgccttaaagtccttataggccgctgcaatttcctcatctgacattccttccatgtccccaaaggaaatctctcccagttcaggccggataaaatgctccacattccaatacagattggctgcctgggctgtttccaccgcccgcaggagactgctggaatacactgcctgtatcttttcacgaaacaggcgttctcctaagagagacgcctgcctgtatccttcttcacttaaatccacgtccacattgcagagcctgctgcactggcgtccgtggcggatcagataaagcttcatccatcctcctccggttccaacacgccgtaagtccggttgaaaccttccttcccatcccttagttcttgaagctgtggatcggcgcaggaatccttccgcctcttgtcacgaacttctcacaggaaaatgtattcacagggataatgggcgcgtatcccaaaagtccgccaaattccgccgaatcgcccaccttcttgccgataaccggaatcaggcggaccgcggtggtcttctggttaatcattccgattgccgcttcatccgcaatgatgcccgcaatggtggtggaaggcgtatccccgggaatggcaatcatatccagcccaacggagcagacgcaggtcatggcttccagcttctcgatggtcagcgcgccaaggcttaccgcatcaatcatcccctggtcctcactgaccgggatgaatgcgccgctaagccctcccacataggaggaggccatgacgccgcccttcttgacctggtcgttgagcatggcaagggctgccgttgttcccggcgcgcctacgcgctccaggccgatttcctccagtatctcggccacgctgtccccaaccgaaggagtgggggccagggaaaggtcgatgatgccgaacgggattcccatgcgtttggatgcctcctgggcaacaagctggcccacgcgggtaatcttaaacgcagtcttcttgatggtttcacagagcacctcgaagtttgccccccgcaccttctccagggccaccttcacaacgcccgggccgctgacccctacgttgatgatggcatccgcctccgtgacgccgtggaacgcgccggccatgaatggattgtcgtccggcgcattgcagaacaccaccagctttgcacagcccagggagtcgttatccctggtggcctctgccgtctcctttacaatccttcccatcagctccaccgcatccatgttaaggcctgtcttggtggaacctacattgatggaactgcagatacgctcggtctgtgccagcgcctggggaatggaaaggatcaggttcttatccgcagccgtcatccccttgcttacaagggcagaataaccgccgatgaagttcacgcctacttccttcgcagccttgtccagggtctttgcaatggtcacaaaatcttccggggacttgcaggcagcgccgcccaccagggagataggtgtcacggaaatacgtttattgacaatgggaatcccgaaatcgcgctcaatatcccggcccgtggccaccaggttgctggcaagggtggtgattttattataaatcttatcattgagggcgtccagattgctgtccacacagtccaggaggctgatgcccagggtgatggtacgcacatccagtttctcatgctcaatcatattattggtttcatttacttcatatatattaatcatgtccgcttgtccctttcttatgtggtgctgtattagattctgtgcatcttgatgaagatatcctcgcgctggatcttaacccttacgccgatttcctctcctgcctgctccagttcttccgacacctgtccaaaggacttggtcatgctgctgacatccacaatcatcatcatattgaaatatccctgtacgatggtctgggaaatatccaggatgttaatctggttctcagccagatatgtacatacttttgcgatgattcctactgtgtcttttcctactacagtgataattgctttgctcattttcattctcctcataccattgttttcccggaaatacatgggtgtaaatttatctttcgtacattgtagcatatgttccccaaaatgtctgcattggttttgagattttttattttaaaacactgaccttaaagcacagacataaaaataccggccaggtatattacccggccgatatgattaaaacatatcttatccttcatcctttacagatacacgacctcgctcatacagtccctgccagctaccgatatggaaaaatcagaagccccgtaaggacagtcgccctcgtcaatctcaagccttactgtttcataggccagttcctcgtagttgttctccttgctgagatggcccaggaaaatcttcttaagcttgtcgtgcagtacgcagtttaacagcctgcctgcattttcattggacaggtggccgtggtcgcccagaatcctgcgcttcaggtaatatggataaggacctgtctccagcatgcggacatcatggttggattccagcaaaagcgcatccagcccctgcaggttgtcaattatgtactggtcaaaatgacccatatccgtggcaaccgcaaccgacttgctgccgcatcttaccctgtatgcaaccgggttggcggcgtcatggtcaatgctgaagggcttcacatgcaggtcgcccagcatgaaatccacgtccgggcagacaggcgtaagcagttccctgtcaaactccccaagactgcttgagcatgcaatctcatccaatgtctccctggtcccgtaaaccgggatatggtacttcctggataatacgcccagccccttaatatggtctgaatgttcgtgggtaatcaggataccgctcatatcattcccggtcagcccgatttcattgaggccctgctggatccgcttgttactgatacccgcgtccaccaggatatgtgtgtcatcggaacctatgtaaatacagttcccgctgcttccgcttgcaatgcttaccattctcatgtctgtacagtcctcttcctaattagtcctcttacggggatatgtgccgcatcagcgcggcaatctgcatccttgtctcttccaggcttttatcattatcaatgaccgagtcacaaaaggaccggaacacttcatcactggcctgattgtccatgatgcttaatgtcttctcacgggtatatccgcggcccgtcttaagacgctccatgcggttctccctcgatgtataaacataccacattttgctgcacttgtcacggaattcttttgaagggatggcggcctctatgaccacccgcccttccctggcctccctggcctccttcattgcagccttccatacaaggggatgggtcagttcatccacccgtctcctctttaccgggtcatggaaaatgatgtcggccatgacggcccggtccaggcttctgtcctcgtttaaaacagatggccccagataatccaccaccgcatggtagccctccattcccggctccatcagccctttggcaacctggtctgcctggattacatgaaatccataatccctttgaaggatatccaggatcctgcttttcccggaacctaccccgcctgtgatgcctaaaatgaatttatccttaacgttcccacattcttccaattctgattgctccttttacatccccggccatgcctttttactttgcatcaaaccaggatctgcccacctcggcctccacctccagtgaaaccttgagttcagccgcatgtttcatcttatccaccaggatttcctttaccgtcccaatctcgtcctcagctgtctcaatgagcagttcatcgtggatctgaagcacaatcctggactttaagttcctggcccgcagttctcggtccactgcaatcatggcaatcttcatgatgtccgccgcagagccttggatgggcgagttcatggccacccgctcgccgaactggcgctgcatgaagttggcggacttaagctcgggaatcggccttctcctgccgtaaagggtggtcacatatccctgttccttgccctggcttacaaggccgtccaggaatatctttacccccggataagtctcaaagtatttattgatatactccactgcctcttttctggaaatgctcaggtcctcactgagcccgaatgcgctgattccataaacaataccgaagttcacggccttggcattgcgccgctggaggggcgtgacctccccaaggggcacatggaatacttcagaggcagtgatggcatggatgtcctgggcggaacggtacgcctcaatcaggcgttcatcccctgacatatgggccaggatacgcagttctatctgggaatagtccgcatccacaaacacacagccatcttttggcacgaaaacctttcggatttcccgtcccagttccatgcgcacagggatattctgaaggttaggctccgtgctgctgatccttccagtggcggtgatggtctgattgaacttaccgtggatcctgccgtcctcaccgatataggcagccaggccctccgcataggtggagttcagctttgtcagctggcggtaatccagtatcttctggaccaccggataatcaggcgccagcttatcaagcacatccgctgccgtggaatagccggtctttgtcttcttgcccccaggcatcttcatgtcctcaaagaggatttcccccagctgtttcggggagttgatattgaattcctttcccgtgtcgcggtaaatctcctgctccaggtccacgatgcgcaccttcaggcggttgccgtactcttcaagctcggcccgttccaccttgacgccttcctgttccatgtggtaaagactgtagatcagcggcatttcaatctctttgtataaaccgtacatgccggtatccttgagctgccgcgtcaggggcgccgctgccttccataccgtataagccatatagcaggcgcaggtcactgccctggcatcttcattccaaagggcgtcccccagatccgccttggccagcagatctgccctggacggcacggtcaggcccaggtaatcccttgccaggtcatcatacccataggtgtccttaaggggatttaagaggtatccggccaccccgccgtcatataccggagcggtatcccctgtttccagataaggcagcatttccttaaggttcagcacccatacctcatggctggagccaggctttaaggcgcacagggctttcacctgccggatcaggaactccccggacagcttctctccggccgccatacaatagatatcctcttcccccaggcacagggccagtccggtaaccggattcaggccggattttgccttcttgcctgcctttacctccccgttttcatcaaaactgaaggacaactgttctgccgcctccggctttgccgccttggcgcctgcctgggttcctatgataagctgaagtcctgtcacgccactggcagccgccctggcaaacacatccgcagcagacgtttcatcccggataagggtaaaatggtcttccaggctggaagcggacgcatcccccatggcggaggcgtcaaagcgggaaaggatggacttgaattccagacgcttcatgtactggtacgcttccggcgtataaagattgtcaatcctggtatcctcatagttaaattccaccggacagtccgtgcatatggtggccagttccttgctcatacgggccatgtcgtaatgctcctcaagggctttcctggccctgggaggcttaatctcatccaggtgggcataggcgttctcaatgcttttgtaggcagcaatcaggctggtggccgtcttttcaccaatggagggaacacccggtatattgtccgaggaatcccccatcagggcctttacatcaatgaattccgtgggtgtaacctggtattcctgttccacgtccgcaggataataatccttgacctcggtccctcccctgctggttttggggatgcggatcttaatgtgttcatccgacagctggagcaggtcccggtcgccggagaccaccgatacgtcgatgccctgtaactggcttttcctggcaaccgtgcccagtatatcgtccgcctcatatcctgcaagggtcaggatcggcacgcccatggctgtcaggacctccttcatcaggtccacctgctggtggagttcctccggcatgggtttcctggtgcccttataggcatcgtacatcttatgccggaaggtgggttccttaaggtcaaaggcaaccgccagatggtctgccttttcctcctccaggattttaaacatgatatttaaaaaaccgtacaccgcgttggtatgaaggccctccgaattggtcaggtccggtaccccgtaaaatgcccggttaagaatactgtgtccgtcgattaaaactaatttatccatcctttgatagtcctttctctataatcccaaaaagccgctttgcccccacatcctgaactggagcaccaatatcatgagaagcgcccagaaacacagggtattcactgcatatctggctgtcttaaggagcataagtgtatggatacgctgcctggacagctccagcgcggtctccagggcgcccttgatattataggtcccggtcccttcatccagctgccgtatgcccacgtccaccgtgaaataaatctccagctcttcccggcattccccgcacccttcaatgtgcttcaggaattcctccaactcttcatccgtaatgctgccgttgatataaggcattaccagacgttccgcttccctgcaggtcacagccgcacctcctgtctgtcccaatcatcaaatcttcttacatcatacaataaatcatttgctttttcaacaaaacatatgcaccgtcggacgcctataaaagaaaaagtcccaaaagtgacgcaaacacgtcaattctgagacttctccctgccaagggtgtagtgccggcagtgggacttgaacccacacgatgtcgccatcaacggattttgagtccgcctcgtctgccattccgacatgccggcttatcttagcaacgttgattattttatcacaggatggggactttggcaagtattttttgcatataatgtataacagataaacgatcttctggagcctatatgcagaccatatcccctgacaccttaagcaacatcctgtattataaagatatccctgttttcagatataccatccgctaccctgtctttacctctgactgcagccagacagcggcagcatttatcaacggatattatgcggaccttgccgcagggaaggaggattattgccgtaccgtactctatccccaggccgtggaagccgcccgctatatcccggacaatcatccggcctttgagatgtacgggttcacgtcagactatacggtgacatttaactccagctgtattagcagcttatacagggatgaatccacctatatgggcggggcacacggttcagtcatgcgttattccgatacatgggattttacatccggaaagcggctgcagctggaagatttccatcccgggaacttcttcttagtgccggacggtatcattatctattaccagcagtacgatattgccccctatgcggcgggtatccctgaattcctcattccattcagccagcacggtccccggatatgaagcatccggctgccggaaacagtcagtaacaataacagtggtatctggtccttatatataccccgctgccctgcctgcctcctgactgccataccacattgccgggcaggacgcttccatgctccagtaaataccgggcattggcccagttctgcggcgttggttccctgtaatagttcccatcccaggtacatgcatactgcccgcgctggaacaccactgcgcttaccgaatcaggaaatgacgggtggctgacccggttaaggacaacagaacccacgtaaagctgctcatcatccgggtaggactgtgcctcaccacagattacatgggctaaaatatataaatcatcctgtgtgtaggaggataatctggcgcctgcaggcgcctgggcctgggctgcctccatgatgttcctgctcatggaaaatgttcctgcgcccagctgccaaaaggaagcatccccggcgctgccttcatccatcctccctgtcttcagcacatccaccacacggtggatatcctctgttactgccatggcctgtactgacagcgctgttccatcttctgtccggccgtccatatattcctctgcatatactgcacagggaaccgccaaagaaaggataaaggctgccataccggatatcaatatttttttcatgtaaactccttatattttgtatacagatttccattttctgcttttctttatattttatcccaaaatacagaagtctaaacatgaccatatatggataggaatgaccgtatatggcagaacctgtatggataaaaaaagagacaaagccatgaacggttttgtctctcttgccatatcctgccattatatgatgatatggttccggttctattttaatccaagtatctggtctgcatccggtttgattttattccaggcagcagtcagtgcttcccttaatctgtcctcgcctgcaaattccatctgctttttcagaatatacatttcccgctcttttggcggcatctgataatattcatcgtcatcgcaatatgtatcactgagaaaattatacttgttcaccataagcttcttatacgctatctccgcaatgctccaccgctttgtatgttcaccgctgagcacatcaaagtccacaaaaataatgatatccaaattgttattacggtattttaaggcttctattctcataatccctccgctttattcctctgtgcgactctttcattatagcaaagttacatccataaaaccataggattttatttctctaaagaaaagtggtgaaatttttgtagatttgtgatagaataagaacatacattcggcgggaggggtaataatggaactacagccaatctggttcatcattccacttatattattaggcgggattgtctattcggttgtacgcggctacataaagggctgcgtcctggccgttatttccatactcacatcgctgtgtaaccttctttattatatagctggtttcttcctgcacaggcccatggattacctgccttatctggctgtcattccatttttaggcttttcttttattgtctggctgttgattggcggtatctgtgcattcagacagtggccgcggcggccgtctgtgtccatatgcctgattgtcaatatattcctgatccttacctggaacctactggtttatacgtcctatttcctgtgatgcctgtcccatatgcctgcatacagaagacctgcggcaatgacagcaattacaatgattcccttcagttcttccatggtatctccctctcttgatattgcatgcggatttcctcaatattataccacattcataccgcacagtcacttacatattgatgtatcagcattgcctttctttcccccagtatattaaccagctccgtcaatgtcagcaggccctcaacgtatatccatgcaagcctggctgcctctccccccacttctgccactaattccaattgtgtcatgtttccccctctttcaacatgttttccccagccaatataaatgccggcctaatattatattcaatgacacaaagaaagattccatgaaagtaaacggaaaatggtaaaattaaaatgaccagtcggggaactggtcattttaggagaaggtatttcgtttcttatggggtgtagcaaaaactatataatgtattgggggggttacgtctattataatagcacaggctttaaaaaaagtgtgcacaaactttaggatggatgaaaaataattttatgcactttgcaggtatggatgatgtatcaaacgcctgtggaactacccgcggttcgctatcccctcatagaatggaaataccagctgattcggagacaggcctgatacctgcccatcccctgtttctatgattgtccatgaaccgtcttccagttctgcaaagtccactgtatagaaatggctgttcaacccggtgaactgacggaccagggacatgggcaccctgggccgtgaagcgtcctggttggagttggctgttacagacagcacattcccatccaggataaatgccctgtattcattggtcctgccctgtacctttgcaagatccacatattcctttatcacaatcccgccgtcaaaaagacttcctctcaggtttttaaaacgctccagatatccatccagctgctggtccgtatagctggcatcaaaatacgcgggaaagtcagaccctttcactgacttgacataatcctttatcagaaaacgtccatactgcttccttatctcctgccagtctaccggttcatcctgcctgaaaacagtcatcctcggcgtactcccctttatatatgggtaaacattgggaaattcatgacagagcctgtactcttccggtgaattaaccagcctgacatcctgttccagcagggtgtcataaaggtagccgtactgatctggtttaagcatccagccccggtaaatacaggggccaggcttaaggtccacaggataaaacttaagccggccggttaccgcaaattcatcataattataaaaaacagccattaaatcagggaagcggactgcttccctatattcatattcataatccggatccggcttccttatattaaaataatcagacggatataaaataagtgtcctcatcgcttttcctcacacatgacctggggcctgtttaaaaattcattccctggtatcctaatcttaccacgtcaggtcaggacatacaatatggcacttaaaaatgaaaggaatatccgcacggacactctatctctcccttattgtaaatctccccctttatccttctgatatgcgcccggctgccgcacaccggacacacgaaatcagcttcgccgaatccgtccgtgggctgcagcgccaccagcgaggcacggataaaatgatataaattgtcaaagctgatgtccccgcccgccccggggcatccggcagtccctcccgtgtagtttcccatctgtcttcctccatgataatcagttttctgccatgatactatatattatgcaaaaagcggctccaggcgcagcctattggaaaaatcaaagagcgggacaggcctgtcctcttcttcctcagcgcccatggccttgtaccagatatccagcgccctctgaaccgttatctccatatcatgatagtaataaagacttgcacctgtatgggtcaccacgtcctcgatgagcagtctggcatcctgattttcaaacatgacttcattgagattgttctttgtgattttcatcgggtacctccttactccattccttatccacagcttctctcaaattgacatatatttaaatgacatatgctcctgtcatcacatccctgaaatgctcattaagaacatatgttctttatacatacataatatcacgaacgcatgttcgagtcaagccttatctgctattattacatgattttccatatcctctcttgcttttatagttgccatataatataatgtggaagatattctaatttataatttccacttatgcaggagcatggaagggttacggatcatgttaacaggctattttaagaaaataggaatgcgccgttttgcggtcatgacaataggcaatgtttttctcggaatgggcatcagcatattcaaattatccggcctgggcaatgacccgttcagcggcatggtcatggcgctttctgacaggacaggcatcacatacgcccttttccttgtgatggtcaatgcagtcctgttcctgtatgaaatcgccgcaggcaggaaactgatcggcgccggtacgcttatcaatgccttcctgttggggtacatagcaaccttcttttatgatatatggcttaccttcatcggcactccggaacagatgatccaacgtgtcatcactgttttaaccggggtcatcataaccagcttcggggtttccctgtaccagtatcccaatgtgggtgtggcgccttatgacagcatttccctgatatggtgcggtaagaaacctcatgtgccatatttctggtacaggattagtacggataccttctgcgcccttatatgctggctgtccggaggtatcatcggccttggcacccttctggcggcatttggcctggggcctattgtccagttctttaatgtccacgtttcttccaggattttagacaccggctccgtacttcaataatttgtaagtttttcttcaaaccccgtccatgaatatcatgtataattatttagcatcggaatacaaaggaggaatcatgatggatacaaacaagaaaatattaatcggcgcaatcagtgctgccgtggtaatcggaggggtcgccatcggcctgatcttaagccggacaccggagaaggcagaccttacaaccatacacacggaggcggccactgaaccgcccagggaaaccctgccccccaccaccacggaggcagagacagcccccacttctgagcgcacggatgccgcttccagcgtgacagcggatatagggacctacacctcaggcaaggtttcaatccagtaccccatcctgaccatggatgatactcagaatcaggataagatcaacgcactgttaaaatccaatgccctttccgtcatcaaggccaatgatattgatgaggcaaaggacaccctttccgtcaaatgcaaaatcatatccgttgaccgcaagcgtgtcaccgccacctatacaggcagtgtttcaagggatggcggagcctatccggtcaacctgttctatgccaacacggtgaacctcctgcaggtccaggatcttgggtttgatgattttaccgatgcctataccatggcaggatatgtgcttagcgacgatgtgaagttcaacggtatctccgccgatgtggaagccgcagtactggaatacagaagttccctggatatcgacacactgacaacggtgtttgacggcgcggatttccccctgtcatctgacacccagtggccggagtccttcagctatgagaagcagggaaccatctacttctccatgccggtcccccatgccctgggagattatgtcatagttgcatttgacccgtcaaccaaataaccgtggtaaaacattctggttgatatcataagatatttgatatataattatcattaattctaatagataaaggagcagctacaactatggataacgtaatgatttttgaccacccgttgattcagcacaagatttccatactgcgcaacaaagctacaggaaccaacgagttccgcgccctcattgaggagattgccatgctcatgggttatgaggccctgcgcgaccttcccctggaggatgtggaggttgaaacccccattgagacgtgtatgacgcctatgatttccggacgtaagctggccgtggtacccatactccgtgcaggacttggcatggtgaacggtatccttgcactggttcccagcgccaaggtaggccatatcggtctgtaccgcgacgaggtgacacatgaacctcacgaatattattgcaagcttcccaaccctattgaggagcgcaccatcattgtgacagaccccatgctggcaaccggcggttccggtgtggctgcagtggatttcatcaaggagcacggcggcaaaaagattaaattcatggcaatcatcgctgcccctgaaggacttgaacgtctccacaaggcacatcctgatattcaggtttatgtgggccatctggaccgctgcctgaacgagaacgcttatatctgtcccggactgggcgatgccggggatcggattttcggaaccaagtaggtttaagaaattttaaggaattacaatagaaaaaatgaaataaaagatataatgccaaaaggcagaaggatgcaacataggttgcacatcctctgccttaattgtttcactgaaatacagctgtttcatcggaatacagtttcactggaatacagctgtttcaccggaacaccctcgtgatatggatggtcagatacaggatttcctcccgggtaataagggtcttcgtggacttttccacatatccgctgattttcatggcggcctccagttcattggggtactggcggctgatctgctcatagaggaaggaatccgtctcctccagcatacggccttctaaaagcctttggacaaaaaactgcagatgggtcacaaaccgtgagaagtacaggctttccgtatccagttcctttttcatgtggaactggaccacggtcaggatgtcctttaccattttcaccgatgacatggtgcgttccatggtcatgccttctgtctgggcattgacaagatggaaggcaatgttgcccgcttcctcttccggaagcttaagccccagacgctggttcagatagtccaccgcatcttttccggccctgtattccctgggatagaatttcttcacctcccagagaaggcggttctggagaacgatgcccttttgacagcgctccatggcgtagataaggtggtccagaagggtaaagaacgcctggctgtccaggggacaggaaaggctgctccccgcagcgtccactgcctcctgtacggcctccagggtttcctggggaatctcttctatcatccggctgtaatccttaaggattcctccctgaccggacacaaagcggcgctccacatccttttcttccaatctgcctccaacctgggtcttgaaacgcaggccgcgtcccatgacgatttcctcctggccttttgcattttcaaccaatatgaaattattattcagtattttcaggaccttcacaatcccaccccctttgcagatatgattgtaacggatatttttatttcacacaagccccatttgtggcaatcacgtccctgtaccagtaaaaactgtcttttttatatcgtttcatttcccttaaatcaaactcacccctgtcaacatagatgaatccataccgcttcccatagccctgatgggtgcttaccaggtcaatggcagaccatggacagtatcccatgacctccacgccgtccgtcactgccagtctcaactggtttatgtgggcggccagatattcaatgcggtaagagtcgtggatggatttatcctcctccagcacatccggagcgccgatgccgttttccgttatgagcaccggcagatgatatcgctcatataccttgcgcagggtaaggcgcagtccttcaggatccaccacccagccgtattctgtttttcccacataggggttttcctccgggcggtacacgccctgctcccccagcatgatctgctggtcccctgcccttggcgccacatcagaaccatctcccctgctggctccgatggtggctgtggagtaatagttcattgcaatgaaatccggtctggcgccggacaggatttccatgtccccgtccatgatggaaggcgcgattcccctgtcctccaggtagcaaaacgccaggctgttgtatctcccgtacatggcagcgtccaggaaattccagcaccggatggattcccagttatgggctgcaatggagtccccagggctgcacgtgaaaggatacatggccgttatatttaaagccgggccgattttggcgccgggacacatctgatgcagcagcttcatggcccgggcctgggccagaagcatgtggtggttctgctgatacagtgtttttttgtcaggaagcccctttcccttaggaaccccgatggctcccggatggaggatcatggtgttctgctcattgatggtaagccagtattttaccctggaaccaaagtgggtatacagtacctttgcatattggacaaatgcctcaatggtatcccggctgctccagccgcccttttcctccagcacataaggcaggtcgaagtggtacatggtaatcacaggttcaatcccgtgcttcatgcacgcttcaatcacatggtcataaaaggcaatacctttccggttcaccgtccccgtgccttcaggcagtatcctggtccatgccacggaaaagcggtatgccttaagtcccatctcccccatgagcgcaatgtcctcctcccagtggtggtagtgattgcttgccactttaaaatccgctgttccggacggatgttcacacatatcgatgatggatggcgatttcccatcctcgtcccatgcaccctccacctgataggctgaggtggaggcgccccacaaaaaatcctctggaaactcttttattctctgataaatcatctaatctcctgcttcctttcctgcatccaaattcatgcgtctgccaaaacctgcgcccggacagctccgggaaagcggctccggcccattggttcctgccagagccttcttcccataccgtttccctggcatgtctttcatcagcagagtttcatcagttccatccctgcttccacgtcccgcggctgtgtcgtaagcacctcggacaggctgccattgttcaccacaaggacgggcgtgaccagatcgtatcccaaatccaggattgcctggcgctcaatcttcaccaggggggtccctggctccaccaggtcatccacactggcaagggcggtaaaatgttttccctggagattcaccgtatcaatgccgatatggatcagcacctccacgccgttttcgcatgtgatgccgatggcgtgctttgtctcaaagaaagcggttatccgtcctttcaccggcgatacgatggtatctcctgtcggtatgaccgccatgccctttccaaggacaccgctggagaacacggcgtccctgacctctgaaaggggaaccgcacggccgcttacaggggattggatggaaaatgccttctgtccggctgcggcctttacggacgggctttcctctgtgccgccttttccttccttaccattcccttccggctcctcaaatcccatcacccaggccgctgcaaaagccgccgcaaaggcaatgacacaagtaatgaccgcatggacaatattcatgggattctcgccgatgaaggcgggaagcgccgccaggccaggggacacgaaggcataccgcaccaatccggacagacccgcatagattcccgcaatgccgccgccgatcatggatgcaatcaaggggcgttttaacttcagtgtgacgccgtacagggacggctccgtgatacccaggacagcagtgatgcctgtggaggttgccagctgttttaattcctggttctttgtctttaaggccaccgccagggttgccccgccctgggccacattggaggccagcatgccaggtccgttaatcatctcagaacccgtcttggtaagctgcatggtggcaatgggtgtcatggcccaggctgtgccggataccaccagcacgggctgcagcgcgcccataagcgcgggaatcagccagctggcctttccgttgatgaactcagctccggctgcaatgacgtcattcaggaataccccgatagggcctaccagcaggaatgcaatgggcgctgtcacaaataatgtaatcaacggcttagtgaaaaactttatcatggaaggggataccttttccgcgaaccgctccacatgggacatgatccaaaccgtaaagatgatgggaagcacgctgtaggaataatccgataggatgaccggtatcccaaaaaacgtaatgggcgccccggctgacagcatgccgctccaggtgggatgcagcagggtgcaggccagcgtcatggccaggatgggactgcactcaaacttaattgcggcgccgtaagctaaaagcacgggcatgaagtaaaatgcgccgtctgaaatcatgttcagcatctggtaggtacttccgtccgtgttcaccaggttcataagggtgagcactgccagcaccgccttgatcatacctccgcccaccagcgcaggtatcacaggtgtaaaggtagtggaaatgatgctgatgatccttgtgagccacttctctttttccgcggatccgcctgcatgggaaccgtccggctgggaaccgccgccctgtccttcgccggtaatttccttgatggccctgtaagctgtctgtacctcattgccaatcacaacctggaactgtccccctttgtcaaccacactgatgacccctggtattgcctccacccgttcccggtccaccttccctttgtccctgaacccaaacctgagcctggttgcgcaatgggtcagcattgccacattatcctttcctccaactgcctccaggacctccagccctgttttcctgtaatccataccaatctctcctctcgcggttctcagataaactcataaaaagtgcacaaaaaaagaccaaacataacagacactatatgtgtccatatgatttggtcttgcctgcattaccagtaacagcctcattcactgttattcaattgattgtcttaagacgtaattaagtttatcagactgtctttgacattgcaatattaaattctgccaaaatagatagggcaaattcggttaatatgcacaagggcaggaatgcattttcaaacacggcctattacttaacgaccttcagtccgccttttcccggctcggcagcgggctcagctgcttcctctgtctccctggcttctttgattacgatgttctcctggttcttgtagatggaatcagcaggcacacagccccttacgctggacaggggatatacattggaattccttccgatgatggttcccggattcagcacgctgttgcagccaacctccacatggtcacccaggattgcgccgaatttcttaaagcccgtggtcacatccccatcctcggcatggaccttgactaaggacttgtcagacttgacattggaggtaactgcgccggcgcccatatgcgccttgtagcccatgatggtgtccccgatatagttgaaatgaggcacctgtgcgccgtcaaagatgatggagttcttaatctcacaggagttgccgataacagcgccctcgccgatgatgacacggcctcttaaaaatgcactctggcgcacttctgccttggcacagataatcataggtccgcccatggcaatggtaggggcaatcttggcagatctgtggatccagatgttcttgcccaccttcttatactcggtctccggcaggtttggccctatctcctcaatgaatgccccgatattgggaagcacttcccacggatatacctgtccttcaaacagcttctctgcaattgtatggcttgtgtccaaaagttctttgattgtcatctgttccagtttcataaattagttctcctttttattagattcctgtcttttatagtgtgcggcagccgaatcaaaaaacctgcgcatatcgtactggttattcatccggattacattcactgtcctgcctgccacaaaacgctccagcttctccatgtattcatctgaagtgatggagccctctgacacataggtaagtcccttttcccagctggctgtcagatccgggttcagaagctggtggatggaatgttccaccacatcgaacaccatctcgcctaacagggccggggtaatgacctgggttttcttgttaaggctcagatacttgatgttaaacagctttttcagtatctcggccctggttgcgctggtcccgataccgcttcccttaatctgggcgcgcagttcctcatcctctatgagctggcccgcattctccatggccaggatgatggaaccagaggtgtaccgcttgggcggggatgtctccccttcttttatattcagatccacaagagtaagtatatcattttttttcagatctgcaagcatttgcagcaatactgtcctgtcaacttttggagactgtacctccgcctccccggtgttttcctggttctgggcatcgtccccggccttgccggactggccctcctcaaaggtttcctccacgccggtcttcttagccaggttcacatccgccaccttcaggtatccaggctcggccagcaccttgaagctggcaaagaaatgttccttcatccgctccagctccaggctgtacttctggtagacggcagccggataaaagatgcttaagaaccttctgcatatgacctgatatactttttctgaaagcggcggcaggttccttgccgacccggctccctgtcccgtgggcacgatggcgtagtggtccgtaatctgtttgtcattcacatacctggttttggctattcccttaaatgaaccgccatccaggatttcctgggcaaattccgccatggggccgtaattcttaaggccgccgatgttcttatatatctccttggagacagcggtggacagcaccctggcatcggttcttggataggtgaccatcttcttctcataaagctcctggaccaccttaagggtctcatccgggctgatcttaaacatcttggaacaatcgttctgcagctctgccaggttgtagagaaggggcggattctttgtctccttcttcttctccttggaaaccaccactgcttccatgggcggttcttcccttaacatggcaatcagttcttctgcgtgctccctgtccttgaatccattatccttgtacagatgtggggtgccgaaatacctggaaccttccactgccttccactccgcgtcaaatgggacaggcgccccatcctttcccggtgactcaaagtttccgatgacacggtaaaaaggagtctttacgaaattgcggatttcccgttccctgcgcaccaccatgcccagcacgcaggtcatgacgcggcccacggacaggaccgtgaacctggtccccaggtaattggaaagggccggaccgtacttcagtgtaagggccctggaaaaattgattcccatcaggtaatcttcctttgcccttaagtaggccgaggccgacaggttatcatattcggcttcatccttagcctcccggattccccttaatatttcttcctctgtctgggaatcaatccacacccgcttctgcttcttatccttcacatcagccagctgggcaaccagccggtatatatattccccctcgcgccccgagtccgtgcacacatagattgtatccacatccgggcggtttaagagacctttgacaatttcaaactgctttgcaacatttccaatgacctcgtacttgaattccttgggaaggaacggcagggtctgaaagctccagcgcttgtatttcgtgtcataggcttccggataactcatggtcaccagatggcccacacaccatgtgacaaccgctgtatccgattcaatatacccatcctgacgcctgccctttatcttaagggcttctgcaaactgctgcgccacactgggtttttccgctatgtataatgactttgacatccaatccctcttttgctttctctgctatacgcggcgcaaaatgggcagattttccagtgcccgtcacagcgcgtattcgtatagtataccattaaatccggtccgtggcaatgatgggaggaattaattcatactttagttacatatttgtaataaatacaggggcgccggattatccatcagcgcccctgccattgtcttatacggtcaggaatttatagattgtagtggtcttatattcctgccccgcctttaagataggggaaggaaattccggcttatgcactgcgtccgggtagtactgtgtctcgaaacagaatgcatggcggtaatcatagtgggcattgccctttcccggcagttcatcattcagaaaattggctgtatagaactggatgcccggaaggtccgtataacactccatcacgcgtccgctggcaggatccatggcctttgcagccagggccagctcgccttccgggtggtccagcacccagttgtggtcataaccttttccgaacaccagggcctcgaaatcctggccaatatcccgtccaatgggcttcatctgcgtaaaatccatgggtgtgccggctaccgggacaatctccccggtgggaatggacacctggtccgcaggcgtgtaatggctggcattcagccatacctcctggcccagcacatccccgctgtcatggcccgccatgttaaaatagctatggttggtaaagttggccaccgtgtcggcatcgcacaccatatgataatccagtacaagactgttgtcatccgtcaaggtatagctcacggtaatctttgcattgcccggatacccctggtccccgtccgggctgtccagatagaaatccagcctgctgcccttccctgtctcagaggcattgcacgcccacaccctgtcatgatacaggtccgggccgctgtgcaggttattgggtccgtcattggcagccaggggataatccttgccatcaatggtaacaacagcgcctccgatgcggttggcattgcgccctaccggcgcgccgaaatggggcgggttcttcctgtagctgtccaaatcatcatatcccagtaccacatcccccagtcttccatccctgtccggcaccatcatggacacccacacgcctccaagggtaatgaaggaagccgataccttgttcttatttaccagcgtgtacttgtaaacctcagtgccgtccggcattgtcccgaatagttcctttgcgattgccatatgttcctcctcctggtaattattttgcctggatatagccctttgcagtcagcagttccgcacagagcacagcgcctccggccgccccgcggaccgtgttgtgggacaggcccacgaacttgtagtcatataccttgtcttcccttaaacggccaatggagatacccattccattctcaaaatccacgtccgccgttacctggggacggttatcctcattcagatactggatgaactgctttggggcgctgggaagtccaagttcctggggaagtcccttaaagcttaccagcttctcaatcagctgttcctttgtcactttcttcctgaacttgacaaatgccgccgccgtatgtccgttcagcacaggaacacggatgcactggcaggtgatgacagggctttcagcctttacgatcacgccgtcctccaccttgccccacaggcgcagcggctcctgttcgctcttctcttcctccccgccgatgtagggaatgatattgccctccatctcaggccagtccttaaaggtcttgcctgcgccggagatggcctggtatgtagttgcaaccacctcgtatggttcaaattccttccacgcggtcagggccggtgcatagctctggatggagcagttgggcttcaccgcaatgaatccgctctttgtgccaaggcgctttttctggaacggaatcacgtcaaaatgttccggattgatttccggcaccaccatggggacatccggggtccagcggtgggcgctgttgttggaaacaaccggggtctcggtctttgcgtatgcctcttcgatggtcttgatttcttctttggtcatatccactgcgctgaacacgaagtccacgcctgccgcaaccttctccacctcgttcacattcatgacaaccagctgcctcacagcctccggcatgggggtggccatcttccagcggtctcccaccgcatcctcataggtcctgcctgcggaacgcgggctggcggccactgtcaccacctcataccatgggtggttctccagcagggaaataaaccgctggccaaccatacccgttgcacctaatacgccgactcttaatttcttttccatagtcccttcattctcctcattgtccatttttcatccgccagtggaggaacccttccttaatctgtgggggaattattcctgtatcggggaatctttccctatcctataccaaatccagtaaaaatgcaacaggaaattcgtcttttgcgcacatttgtatcccgtatgcggacacgtcctgccatttgtatgcggacaggccaatacaggggataggaaaatgcctacaggcgcaccttgctcccttttccgtccctcctggccagtttcagccggttcatgtggacttccttgcccttataatcaatgacagggttatccccaatcaggtataatttctccagttcctcattcttggccagcttaatgcccctcacgcccctggacgccttctttaagacggatatctcctccagcgggaaccgcaggaacacgccgcttgtggtctgcagcaccacttcctcctgtccctccaccgggaggatggatatgacctggtcgccctcctgcagcttggtggccgcaaccatccggttattggtttcaaactcttctgccgggacctgtttcaccatggccatcttagttgcaaacacaagggtggcgccctttaaatcctgggcgcatgtaagatagacaatggagtccttggcgccgtcatacttgctcaggttctcaatgggcacgcccttgtccctcagcttgccggcaggcacatccatgaccttaatctgatacaggtttccgctggcggcaaacaggcagatcttgtccgtgttcaggcagcggactacatggacctgttccgtatcaacggtttcctggttcctctcataggtggacttgtcaaggagtttgcagtatccgaaccggtcaaggacaaagaccacttcctggacctggaccgcgctctcatcgtacacggcttccgggccatcctcaataagggtgcgccttggaacggagaattcctccttgatggcggccaggtcatccttaatgacccggttcatctctcccctgctgccaaggatcttcttatatccagcaatcttccttaaggtttctttgtgttccttctccagggccaggatttccaggccgattaacttgtagagccgcatctccaggatggcggaagcctggcgctccgtgaaatgcagtttcttcgcatcctcctcaaatccctgcaccttaaaccggatgttggacacatcgccggttgtcaggcatgccttggcgtccttcaggttcttggaacccctgaggatggcaataatcaggtcaatgcagtcgcatgccgtaatcaggccctcctgcacttccttcttatccatctccttctgaagcaggacattgtacttgcgctccgtgttctcatactggaaatccaggaaattgcgcaggattcccttgaggctcagtgtctccggacgcccgcctgcaatggccagcatgttgaccccgaaggtatcctcaaacttagtcttcttataaaggatgttcttaatcttttcaatgtccgcgtccttgcgcagctccagcacgatgcggatgccttccttgttggactggttggagatatccaccacgtcggtcagcttcttgctctccacaagatctgcgatgtccaccaggaacttattgatcccggcccctatcatggtatagggaatctcggtgatgacaagcttgtccttatccgcctttcgctttccaagctccacctcgaacttgccgcgcagcttgatttttcctgccccggtctcatagatgaccggaagctcgcttttattggcaatgatcccgcctgttgggaagtccggcccgggcatgtattccatgagctgttccgtggaaatatccgggtcatcgatgtacgccctgaccgcatccaccacctcccccaggttatggggcgggatgctggtgctcatgcccaccgcgatgccttccgccccgttaatcagaaggttgggcaccctgaccggaaggacctccggctccttttccgtctcatcgtagttgggtatgaagttcacggtcttatccaggtccttcagatacacttcctgggcaaatttctccagacgcgcctccgtgtacctcatggccgcagccccgtccccttcaatggaaccgaagttaccgtgtccgtccaccaatgccattccctttttgaactcctggctcatgacaaccagtgtctcgtaaatggagctgtcgccgtggggatgatatttacccatggtatcgcccacgatacgcgccgacttcctgtggggcttatcgtggtccaggcgcagctcgctcatatcgtagaggacccggcgctgtaccggctttagtccatccctggcatccggtatggcccttgcagtaatgacgctcatggagtaattcatgtagctcttctgcatttcctcgctatattctgtccttattatcttttcagccatgttattgtcttctccttgtcctatgcgcttggaatgctttacgcatcaatctccgcctcgtccgcgtgctcgtagatgaaggtacggcggggagccacttcgcttcccatgagcatctccgttatctcagaagccatcctggcgtcctcaatctccacccgcttcaatacccggcgttccgggtccagggtggtttcccacagctgctccgcgtccatttcaccaagacccttgtaccgctggagggtgaaatccccggtgtgggtcttgcggtagcgttccagttctttctcgtcatacaggtactgctcctcgccccgcttgggaatcaccttgaacaggggcggcatggcaatatatacgtgaccgtcataaatcagttccggcatgaacctgtataaaaatgtaaggagaagggtgtcaatatggcttccgtccacatcggcatccgtcatcagtatgattttattgtaacgcagcttcgtgatgtcaaagtcattgccatagccctctgagaacccgcagccgaaggtattgatcatggtcttgatttccgcattggcaaggaccttatccatggaggctttttccacgttgaggatttttcccctgatgggcaggatggcctgataccggcggttcctggctgtttttgcggaacctccggcagaatctccctctacaatgaaaatctcgcatttatccgcgtccctgctctcacagttggccagcttgccgttgctgtcaaatgagaacttggatttggtcagcatattggtcttggccttttcctcggcgcggcgtatcctggcagacttttccgcacaggcaatcacgcccttaaggacttccacgttgcggtcaaaatacagctgcagttcgtcccctgtcacggtgaacacggccttggtagcgtccgcactggccatcttggtctttgtctgtccctcgaatatggggtccgggtgcttgattgccaccactgccgtcatgccgttgcgggtgtccgctcccgtaaagttggtatctttttcttttaatatcccaagctccctggcatagctgttgattaatgcggtgaacttggtcttaaacccagccagatgggtaccgccttcctgtgtgaagatgttgttgcagaagcccaggatattctcctcaaaggtatccacaaactggatggccgcttccacctcaatcctgtccaccgtgcccttaaaataaatggggtcatgtaccgcagccttgcccgtattcagttcctttacataggcaatgatgccctccggctcatggtaggtgatcttctcattctcgcccgcccgcttattctcatagcagatggtcagcatgggattcaggtaggcagtctcatgaaggcggcttttcagccattcggccttgaacctggtcttctcaaaaatatccccgtccggaaggaaattaatccgggtgcctgtctccctggtcttgcccacaacgggaagcagcccattctcaagtttgatgatgggctttcccttttcgtattcgtcatggtagatataaccgtccctgtacacctttacgtccatgtgctctgacagggcattaactacggaggagcccacaccgtgaagtcctccgctggtcttataagcgtcattatcgaatttaccgcctgcatgcagggtggaaagtacaatcctggcagctgaaagcccctttttgtgcatccccaccgggatgccccgcccattatcccgcaccgtgcaggaaccgtctgcctccagggttacccagacactgctgcagtaaccggccagatgctcgtccaccgcgttatccacgatttcataaatcagatggttcaagccctttgagccaacacctcctatatacatgcccggacgcttacgtactgcttccaatccttccaataccgtaatactgtccgcattatactgttcctttgccattgcaatcctccatatccaataagtacatacgtacgtttcatcttatagtattaaaacatatttagtttgttttggcaagttttgggcggagaatttttctccatccggtttttgaaggcggcgcatacccgcgccggtgctgataacagacccattttcaccaatgtccatccacggacataccttagggtaaaaggaggtaaaaccatgagcaacatgccttatgccaatcccatccagggaaacctgaccatcggtaattccctgatcatctacgacggaggatactattcgctggacggcggcagcaccgtctcttccgacaccatcgggccggataccctgattaccgccccttccgtcagcgccgtgtccatccggcttcagaacacacagccggtccgtgcaaaaatgatttcaatccctaacggcagcctggaaatcacaggccccggaaccatacagacagataaccaggatacgcctgtcctaagccgcgccagcggtatccgctcctacggcagcctcacggtcagcggcggcgcgtccgttgaagccgtgggcctgaatgacggcatctactgcgcaggactctccaacaccctcactgtaaccggaggcagttccatctacggaaaaaccacaggaatgaatacttccattctcggcgcctccaaatacggggtttactgcggcggcaatatcgtggtcacggaaaacagccggatttccggtgaaggggccatggactcttacagtacctacggcgttttctgcgatgccggacacgccatggccaccgccatgtcggtctcagccggaagctctgtcagcggcaccgctgcggtgggggtctatcttggcggcccggcggttgtggacggttccctctcaggcactggcggcgggctgaacatatcccatgggatccagggcgataaggccagcattgccgtgggacccctggcagatgttaccgcaacagcccagtccggcgcatatgccggtatcatcatggtttatggatatgaaatcaacggcgggaccctcactgcgtccggcggtatctacggcctgcgcagcatttcctccggcccggtccgcgtcacggacggaacccttaccgccacaggcagccccaccgccggcagttatgggatttatgtggaaaatgaggggctggctgccgtaaacagccagatacgcggtgaaggcagccgctgcggtatctataccggaggcagcctgacagcccggagcagcacggcggacggctatacctatgcctacggcgccgattcccagggcagctacggcgccattatagccgcagggagcataacggctgtggattcccgtatcatagagaattattccaggacggaatatttcgacgaagcataccagattccatatgaaacaggaaaaaacattacagattacaggaactacacctggagcatcacctctggatccggtgcagttgccagttctcctgacggccagggtatccatgcagttttaagcggttccggcatactgacagccttccgccagggtcctatggacagcgggattgtgtctttggattctgagagtacccacacaatccatattccggtggaactgacagccgctccccttcccgaatataccgtaacatatgatgggaacggcgctaccggaggcagtattcctatggattccggcaatccctattatgcaggcagccttgtgacggttttaggcaacacagggaacctggtgcgcgcgggatacaggttcattggctggaccctcactcccgatggaaacggaaccgtctatcagggaggggacaccttcctgatgcctgaaaacaatgtggtcctatacgcgctgtgggaagccgtccctcccgtctcctacacggtggtgtatgatggaaacggggctgaaagcggcacaatcccggccggaccggaagcctatgaggcgggcgataccgtgattgtccttgggaatacaggaaatctctccagatccggttatgtgtttgccggctggtccatggatccggacggttccgggcctgtataccaggacggggatacgttcctgatgcctgcaacagatgtaaccctttatgctgtgtgggagccctttaatccaccggttcctccgccggtcccgccttgctgctgtcactgctgccatccctgctgttatccgtccggttgccgcccttcccggtactgctgccctgctcaaggcaactgtactccatggtgtggctgtactccctggtgcggctgcacttccaggcacggctgtccggctcagtatgggtgcaccctccggtgcggctgtccggctcaatatggctgcactcttcgatgcggccgtcctgcccactccggctgccctgcccagtacggatggtcaccttggtatggctgtccttcccggtatggatgtccttcccagtatgaatgtcctccccagggctatcctcttccgaacagccctatgccaacatacaatcatcctatgccataaatgatatatgggccgatgatggttcccgctttccgggcataaacgcaaaaatagctttccatatcggaaagctattttgcattcaggtctgttctcagacactttaagcagatgacgggaatcgaacccgcctccccagcttgggaagctggtgttctaccgatgaactacatctgcgcaacaaggatattataccatatatttctagtatttcaagtatatttttaaattttcctaattttcctaaatttttcttattttctaattgtccggaacaggtccggagccagtttatcctgctccaaacccgtccagacctgtccacatcttctgttcccagacctaatccggttcctgtcttctataataccttatccaggaaactcctggtacgctcttccctggggttaccgaacacttcctccggcgtgccctgctccacaatataaccgtcatccatgaaaatcacacggtcggccacttccctggcaaatcccatctcatgggtcaccacaaccatggtcattccatccgccgccagctgcttcatgacctccagtacctcaccaaccatctcagggtccagggcggaggtgggttcatcaaacagcatgatatccgggttcatggccagggagcgggcaatcgccacacgctgcttctgtccgccggacaactggcccgggtacacatccgccttgtccgacagtcccacccgtcccaaaagctccagcgcctttttatccgcctcagccttgttcataagcttcagctgggtaggcgccagcgttatgttgtcgcggaccgtcagatggggaaacaggttgaaatgctggaacaccataccgatgttctcacgcaccttattgatattggtattggggtcggatatggggtgtccatccaccaccacttccccggacgttattttctccagccggtttaaacaccttaagaacgtacttttaccggaaccggaaggccctatcatgcacacgacctccccttcccttatctcaatgctgatgtcctttaagacttccaggtcaccaaaattcttcttcagctgctttacagaaatcttattttccataggacactctcctctccacatattttgccaccctggacaggatggtacagatgaccaggtagaatatggccaccgacaggtatataggcatgaccatggaggatgcgttggcagctatgatcttactgttctgcgtcagctcccttggtccgatgaccgatattaaggatgtgtcctttaaggaaatgatgaactggttgatgattgtaggcagcatggtacggaacgcctggggcaggattaccttgcacatggccttgccataggaaaggccaaggcttctggccgcctccatctgtcctttgtccacggcttcaataccgcctctgattatctccgccatgtaggcgccggcattcaggctcagggtcacgcagcccgccgagaatgcccctcctatcatgttccactggaatccatacgggcgcagcatgcttcccacgccatagtacatgatgaagacctgtaccagcagcggcgtcccccttatgatgtcaatataaatattggcaatgaatttcagcgccttaaagtcagataccttgaacaatccgaagatgacgccaagaatcgtggcaaaaaaaagcgaaataaccgtcatctgcagcgtaacgccaagcgctttgaaaaatgacgggtaatactgggttaaaacgttaataatctgcatactatcatccttttctttttttaatctgctgtctgcaggctccggccccgggaatcctgtaaaccaatccccatcccgcaccggattgttatagccaaatttaaagcacttaagcccggctttctgaataactgctttaaatttatccataacctttccgcacattcaggcgccggcccctgcttccaggacacgtcttaagcggcgtgccctgacagaaaccggcgtcctcctgccgcctggcggcggcagacatgattccatcaattatttcgcgatgtaggtacttaagatttcatcgtatttgccgctggccttgatgttctccagtcccttgttgaacatctcaaccagttcaggattggcgcccttaagggttgcaaagccataggaggaacctttctccataggtgtgggaagggtcaggccaagtcctctggaaatctcatatccgataacaggataatcctcaaagcaggcaactgcctccccgccaagcactgcctggtacatatcggaagaactctcaaactgggttacctcaaaaccatactggtctgcgatggattcggcaaaggtgcagccctccgtaccaatcttagcagcaacgttctgcccctttaactggtcataggacgtgatatcggaaccctgaagcaccgccattccaacaccggaatcatagtaaggctcggaaaagtcatactttgcagccctctcgtcggtaatggacatgcctgcgatgacaccgtcgcactcaccggcctccagagctgttactgctgcggaaaaaccaaccgggatgacttcatactcaaagccctggtcctcggcaaccgccttcaggatatccaggtcgattcccaccatctcgcccttatcattctcaaactcaaacggtgcgaaggtggtatctgtgttgatcacatacttcttgccagctgctgatgcagccgcctctgattccgcagccgtggtatcctctgcctgcgcagccgtggtgtctgcagacgcctcggtcgcggcagcggtatctgccgctggtttggagccgcatcccgccattgaaagggccataactgctgccattgataatgccatgatttttttcatgaatatttcctcctcttacaattaaaataagggtgactttaatacatcatgtcgcccttgacttgtgatgcacgtgcatcatgttgttttactataccacaaaggagaaacaaagtcaacttattgtgattgccacagcagaaaagctgtagcatcacattaagattcattcatatcattccttaaactgtcccctgccctgggaatgacggatctggtggatatcagattcccctgacagggaatttttcaacaatccgacctgtgtggtacgcctccaggagcatttccaaatccacgattttcgccctgagccggcatccgatatccgtatcgcccacaagcttacggttggagacacgcttgatgatgatactctccgaatggatatcgctctccttctcaatggctgcctccgttgactcaaagggttcatgggcggccaggatcagtccataggaattataaatcagcgtatagcctgcaatccctgtttctttctgatacgcctttgagaatcctccgtcaatgaccaggaccttgccgttgcatttgaccggattttccccattcttcgacttaaccggcacatgtccgttgatgatatgcccgtcctcctcggacaggccgaattccctgaggatcccccgcgccgtatcttcctcctccagcaggctgtaataaggattcttcttctccctgtgtgtctccttgtccgccaggaaataccgctcaaaggtagccattttatcctttccaaacaaaggggaattttcatggagccagatataccagcagatatcccggccctttttcctttcctcgcagtcaatggccacaaaggcctgccgcacatagctgtcaagacactcataaagcgctttccccttgcatttccttccatatatctccacttccctgaaacttccgtcctcgttcagcggaatacagccatgatagagaaggtttccgttatataccttgtacaggcttcccttggccagcaggaaacgcatgtgctgctgcagtttttcacagttcctgaaggcattgacaagacgttccatgataagcgcttcctccggcgtcagacggtaagggtcctgaggatccacggtggggaaatgactgtccagcatttcatataccgtaccgttgatgcagatactgccggttttgcaatccaccaggtgaagcaggttcctgttttccaactggaacccgggatgctcctttgccaattgtccctccaccttgaactggatgatggagatggccttgtgcatcttcatgttcagttccgtctcgctggggctgcatgtattggttcctttaagcgcaaaacaggcgcaggggtcatccccgtacatgtccagggaaaatgtggccaggggcagcaggttgattccatagccttcctccaggatatccaggttgccgtatcttgcgcagatacggatcacattggcaatacaccccttctggcccgcagcggcgcccatccagagcacatcatggtttccccactggatatccagggagtggtaggacatcagtttatccatgatgatatgcgggccaggccccctgtcatagatatcccccaggatgtggagatggtccacaatcagccgctggatcagttcgctgagcgccacaatgaattcctttgcccttcccacccgtatgatggttgcgacaatggcgctgtaatacgattccttatccctcacatccaccttttccgtaatcagctcctcaatcacataggcaaactccggcggcagggccttgcgcactttggagcgggtatacttgctggccgcccgcttgctcacctcaatcagacggtacagggtaatcttgtaccagtcctccctgttatgtacctgctttaagatctggtccattttctcccttggataatagataagggtcgcaagggtctgcttgtcctggctgctcaatgtgttgccgaacacatcgttgaccttgcgccgtactgcgccggaaccatttttcaatacatgggaaaatgcttcatactccccatggatatccgtcaggaaatgttccgtgccctttggaaggttcagtattgcctccaggttgattacctccgtggaagcagccgcaatggtaggatacagctcggacagccgctccagatatcttgtctcaaggtcgctcatatgtttttcctcctccccgtcaaaaagagcctgcccccatggcaggagggcaggccctcaggataatccgcacctgacacggacggtccggctgttactcagccccgtcccggtcaacgtatatcttctcttcctcatcgatatggtccagttccatataatcctctgtccgcggggacagatccttctttttcaggttattgctcacataggcggataccagcctgtatatgactgcaaatgcaggcacgccgatgatcattcccacaaagccgagaagccccccgaagagcaggatggaaaacaggacccagaagctgggcaggcccgtggaatcccccaggatcttcgggcccaggatattgccgtcaaactgctgtaatatcaggatgaatatgaggaaatacaggcacttcatggggctgatcatcaagatcaggaaggcgcttggaaccgcgccgatgaagggaccgaaaaacggtatgacattggtcacgccgatgattacactgataagcagcacatagggcatatccatgaactgcagggcaaaaaagcacatgattccgatgatcagggaatccagcagcttccccgtgatgaatccgccgaatatgccgtgggcaaaacgcacctcgctcacaaggcggttggcatccttaagcttgagtatgctgtatacaatcttcttggactgggctgccagggtatccttgatattcaggaaatacaccatgacaatcacgccaatgagtatgttcttaaccacggtaaccacacttaaaagcccggtggacagctgtcctatgatcatggacatgttgggaaccagcttttcagtcagccacttctggaattcagataccccctgctcataatagggcatgacaaacttttcaaaatcctggttatcctcaaacatcttgttcatccacatggtaaggttgttgatgtactcgccaatgctctcctgcagccggatgatactgttgtaaatctccggaatgatcatccggaacaggcctgccacaatggcaaccagcacaaccaggctgaccagggttccggccgccttggcaagacggtccacaatggactggtccttgattgccttgctaagcttcagggttgtgtatgccctggttttattgtagatgggcagcatcagatatgccagcaccgccccatatatgatgggcattaagatagatgcaatctttccaagcgcaccggacaccagttcgaaccgggacaggaaaaatccaaatgccacactgagggcaatcactgccagggccgttgtcccccagtaaatataatttttgaatcttgggtttttcatgtattctgctcctatgtttaaagtataccgtcatttttccaggtcatacacccggactcaagattcagtataacataagcagatggttccagcaattgtgttttgacaaacccgcgtattccgggggaatttttacacaattttaacacgcaggcaggaataccggcatcgggaacaggtgtgaaaggaactatacacaaacatccgtttttgtggtatgataaggaataccaatcaatcgaggtgttagaacatgtcttatataattaaaatggccctggacatcaaagcacgttttgaaccgcctgcgcccataacctcccccctggaagcatactgcgccatcggcaccattgcaaaagccatgaaactggatatgcctgccaggaaggacacgctctttgatatgcgggcccagttagataccgatataggcggcgagcctgcggatgaacgcatcggcaaattataccgcatcctgatgaatttcatccgcaacgatgagaccacggaccagatgatggaatatgttacatatggatatgaaaatgaaaaagaatgaaatcagaaggaggtaatgaagatggaatataaagtaatcttccatattgatgagaatgccaggtggcagatgctcttaggaaacgtggaaaaccttcttgctgcttcggaatccgggcacatgaccgtggaggtcctggccaacggcgaggccgtgcagaagtacgcttcctccattttgggaaacggcaatgaatcagaccaaagccttaccgcaaagatggcatccctgcaccgggaaggcgtcaccttcgccgcatgcaggaatgccatgagggccagccatctcacagaagaggacctacagtcctttgttgtcacggttcctgccggagtcatggaacttgtgacgcggcagtcccagggatatgcttatatcaggccctagggcgtgtttgaaaattgctttccgtcggctgtgcgtcccactttgtgggagatttggttccgatgatggaggcgtagcgggctacgctgactgaatcggggccaaatataccgcgaagtggggcgtgcagacggcgggaatgaattttcaaacacgccctagtaaatttccctttcaatatccagtatctcagcttccgtgttctgtgccacaaacttttcaatctcttcctggatactgtctgcctgtgcctgatgggcagccacggccgccagtcctatgacgatgatctgatggatatcctgctcacccacttccgctgcagaaacattgaatttgttctgcagctttgcaagcaggctttttacaaccatccttttttccttcagcgaatgcacccatggtgcatgaagcctgatcctcaatgctaatattgtcatcccttatcccctttcattccaagaaatatgccggctgctgatacaaagaacaaaggcggcacctttgccagccggtaacctaaaagcaggctgatatggttcagtcccatgaacaattcatcaaacagatgcacatctggcaacagcagcggcagaagtacgcccgatgccgctatgaaataaaaaaccagaattccgatggatatccccaataccgtcctcctcacccatgcctgtcttatcctgatatcccccaacagtcccattatattcatgaaggtaaccgttcctgcaaagaaacaggccggacacaggatgagaacggacaggaagcgcggcagaccgtcataatagtgctgggccatcctttccgtccagtcctttgtgaatacataaatcaaggtccctgtcaacgttaatgccccccacaaaagggcattcctgatacactgttttttccgtgcctgtcttgtctctgcatccgcctcctcctggcggcgcccgtataagaccatgaggatatccgtgtcaaaagctcctgcaatggcttccagcgtttcaatatccggctgggttctgccggtctcccagttggagacagcctgccttgtcacatgcagaagccctgcaagctgttcctgggacatcttcttctgttttctcaggttcctgatatttttccctatgctgctcatcccaattcctcccggcacactgttttatagattaaacataccacagaatgccggatttggtcacgcaacaattcattgcaggcccgaaatcctcattatttgatgttgttatagaggaaacagcctgtgacatggtcattaaccattccaacggcctgcataaaggcatatatggtcgttgaaccgacaaacttaaaaccaagttttttcaggtccttgctgatccggtctgacagcgcggttgtggctggcagatccttgatattttcacagtggcccacaatgggcgtattgtccacatacccccatatcatctggtcaaaactgccgtaccgggcctggactgcgaggaatgccctggcattacttatggccgcgttgattttcaggcggtttcttatgatgccctcatctgccataagttcctcaatcttcttatcgtcataacaggccaccagttctggcttgaatccatcaaaagctttgcggaatgcctcccttttcttcaggaccgttatccatgaaagccctgcctgcatggtttctaatatcagcatttcgaacagcctgtcatcatcatgtacggggcggccccattcattatcatgataatcaatgtatatttgggagtctcccgcccaggcgcatcttaccttttcatccattccttttcctccaatcggtgttttgaacccggctgttccatccatgctgttttccataaacaacctgcttttttccggattgctgctttctgtacaaatccattataacatggaatagtgacggtttctgccattattttgtttccgcccgttacatggaccatttgcccatatcaacgtttaaatgtcaggaaatcaaaagaaccgcccatgaccagacggttcttttgatttcctgctcagcagtgctgctgtaaggatagcggttattcagttttcaatgactgtgttacgcaatcgaagcctcaaaacgtctaccgtgtaacaaagatacattatttccagtgtttcaatttaggaagctgttcagaaaaatatgcccttgcctgttctggagtaaaattgccatccgacatatggcttaccaaaaattcaagcaatctgtccatactctcatatgcaaactgcccgtctgtataacaccatttgcaatagtcctcattaaagctgttatctgtttcccggctgataacactatcatcttccaatggcataccgcaacactggcaaatgagttttcttggacttcccagtaatgtattgatagaaacatcaaatgctatggaaatctgttttaatgtttctatattcggcgttgagtcaccgttttcccaacgtgaaacggcctgacgtgtaacagataacctttcagccatttcatcctgggtcagcttgtttttaacacggatgtttttcaatacatcctttgtatccatactttcaccctccctctatggaatgaatctattatagcgtatgtatgttttcctttcaagcaatcgtctattgctattccaatcgataaatggcagcatatatatcaaaaaaaatcccttgatttctcaagggattttcgataagccactggccggactcgaaccggcgacccacgcattacgaatgcgttgcgctaccaactgcgctacagtggcatccggacagtcatgctgtcccttagatgaaacaagactgtcgctcacgcaacagcctcttcatcatgacctgaccgggaatcgaacccgggtttacgccgtgagagggcgtcgtcttagccgcttgaccatcaggccttaggtgaatcgaggcgacgtgattcgaacacgcggcctctgcgtcccgaacgcagcgctctaccaaactgagccacgcctcgatacctttggtagtataatacaaatatggcagaatgtcaaccataaattgtcaaagtttttaaaaaaactcagaattttattttgatgtaatcctgccccatcctgcattcccattaatcgtaaatcctgccataatcgtagctcccataaaaatccctgattgtctcaaaataccggtccacattatcacgggtcagcctgtgctcccctgctgccatccactccagtatccggtcccccacctgctcggagtaatggatgacatccatataattatcaaggtcgcagatgatgtcaaactggtcatcaaacccaaacagccggatattgtcacaggtaaggagcatatccgccatcaggcggagcgccgtaagctggcgttcaaaatccccctttgccacaagctcgctgtcccaatacgcaatgctgtagggagggataaagcaatagaatgtaatatcagggttagcccttgcaacggccagtatattctgttccacattaccttcaaccatctgcctgtcttccatggtaaacggtaccggctccatgttcccttccgggcgcacgaaggtcttaagcacagcctccctgccccactccttatcaggcgcccagtgcatatatccgtcaaaggtggtcatatctgcccctgcctttgtccggttcaatatgctgcgtatattgccgaaaatcacttctttattccatatgtaatccacatcgttccacggattcctgtcaaacaggtaatccggcgccggcgccgtgggattccactcatccttgtcatacatgaggaagcttttatccaggctcctgaacaccatcttaatctgcggatgataggaaatggcccgccacaccgcttcatccacttccttataatatcccccgccgtacgggatcttgattgcatccaccccgaacagctgattaaacagggataccttgaagttctccgtcatggatgtgcctgtgagcaccgcatcgtatgtaaaatgccggctgatgccatcgttctggtaacgctcgctgtccaatgtatatgccagccctttcactggcccatgataatggaaaaaggggtccaccactgccacaagccctcccagggcagccagccccaaaacggtaagccccagcgtaaggcccagccatcttccccagtatttcttctgtccatccctgctatctgtctgtatatccaatgctgtatctcctgtcaataccgataaaattaaacatccttaaaattggaaataaataaaagtggtaatcccggccagcgatatgattgaccacacaagcataaccgctgtcccggcggccctttgcaccgtgggcttaagccctgcctccgccatgttcctggtgttcatcaccagatggattgcaatgccgtaaatcaggaatatggtcatgatcctgtgatttaagaaaacctggggcagctccaccatcttaaaactttctatgaaccccggatttatctgcatgttcccaaagcacaccagtctcttaaaaaactgttttgcctgggaaatgctgtcagccctgaatatgacccagcccaggttcacgaacaggaaggtggccatccactggaacgcaatgtgaagcctgttccactgcctgtcaaacatacggttaaggcattgtgccgccccgtggatcataccccacaggataaatgtccagttggccccatgccacaggccgctggccaggaatacagccatcacattcacataagtgcgcacctttcccttcctgcttccgcccaggggaaaatatatgtaattgcgcaggaaccgtgtcaaagtcatatgccaccgtttccaaaaatccaccggggaaagcgccttgtagggagaattgaaattctggggcagttccagattgaacatctgtgaaatccctaccgccatgtcgcagtacccgctgaagtcaaaatacagctggaaggtataggccagcatcacaaggaatgcatcggcagcgctcaacagtcccacctgtgaaaatccccaggccaccgggcctgcaaaaaactccgcaagtattaccttcttaaaaagacctgcggcaaacaccatgagtcccttggacatattctccgaatccatcctccggcgcgcctcttccgttagctgcggaatgaactccctgtgcaaaagaatcgggcccatggcaatcttggggaaatacaccgtgaaaatggcgtaatcaaggaaaccgtaccctcctgtttcacctctataggaatccaccagccatgcaacctgctggaacgtaaaaaagctgatgcccacaggcaggaggatccttgtcagcaataaatcctgtttcaggaacaggttcaggttctccaagaaaaagttgaagtatttataatagaaaagaagtcccaggttggctccgatgcccagtatgaggatggccttccttttgcctccatcccggcccggggagggggcggaaccggcctcctttacattttccagaagcatccgtgaaattccccagttgaacccggtgctggctaagagcagaagcaggtaccatggattgccataagcaaaaaacagaagggacatggcggccaggaacagcctggcccctgtcttccttcccaagtgctgcaatccgaaataccctccaatacaggacgggagaaataacattatgaacagatatgaattaaactgcatgatccttgtatcctttttcatttgtgatttttatgatcagagcgtcagattcctgagcctgagcgcgttgcccaccacacatacggaacttagggacatggccaaccctcccagcatgggacttaaaagcgggccgcctaacagatacagggcgcctgccgccacagggattcccagcgtgttgtagaagaatgcccagaacagattctgtttaatattgcgtatggttgctttgctgagtctgatggcacggtacacatccatcagatcggatttcatcagcaccacatccccggattccagggcaatgtcactgccgctgccaatggcgcagcccacatccgcctggacaagggctggcgcatcgttgattccatcacctaccatcataactgtttttccctgtttctgcaaccggtttaccacatctgccttatcttccggcaatacctccgccaccaccttgtccacatgggccaggcgtccaatatactgggccgtcttctcattatctcctgttaccatatagacctgcacacccagttttttaatcttccccaccgcctccacgctggtctctttgatggtgtccgcaacgcagatcagtccggccagacggccgtccaccacaacatacatgggggtcttgccaatgcctgcatattccgacgcctgcttttttgtttcatccgatacagggacattcagatgcttcagaaggcggcggttgccaacagccaccttccagccgtttaaggaggtcaggatacctgcgccggtcacgctctcaaacgactccggcatgaccagttccatctgcttctccctggccgcctggacaatggcctggcccaggggatgttctgacatctgttcacaggatgctgccaggaatagaaggtgttcttttttctccgcatcggaaggcgctgctgcctttgtactgtctttgagggttccgtcctccgtctcattgggcggtgtgacacctggcagggccgcactctccagtttccacacctgctccaccaccgaatcgctgattacgcttacatccgtcaccttgggccggccctccgtgatggttcctgtcttatccaggattacggcgtccaccttatgacagacctccagggcctccccgctttttatgaggatgccgtgtccggcccccaccccggtccccaccatgatggccgtcggcgtggcaagccccagcgcacagggacaggcaatcacaaggacagccacgaatatggtaagcacaaaggacaggtccctgcctcccactatccaccacataagggcggctgccagggcgataaccatcacagccggcacaaaatacccggccaccgtgtcagccagtttggatatgggggctttcctgccctgggcatcctctatcatccggatgattttagacagtgtggtatcgctgcccacatgggtgacctccacttccattgctccgttgtaattcatgctgcccccaatcacacggtcccctgtctgtttctctaccggaatactctcgcccgtcagcatggattcatccacggtactgcttccctgtaccaggaccccgtccagaggaatcctgctgccaggcttgattagtatatgctgccccgcctccacctgcccggtttccacctcacgctccacaccattttcgtaaagaagggctgtgtcaggcgccagttccatcagcttgcggatggcctccgaggtctttcccttactccggctctccatgtacttgccaagcatcaccagggttacgaccacggcggccgactcatagtacagctggtgcgccttcatatggtcggccgggattcccagggtcatcacaaggctgtaggcaaatgcgcttcccgtgccgatggccaccagggaatccatgttggggcttccctttatgagggaacggatgcccaccacatagaaccggtaaccgcagaccaggattggcacggtaaggatcagctgcgccagggcaaagttcagcggattcctgtccatttccaagaatgcaggcaggggaagggaaaacggaagcatatgtcccatggaaatgtagagcagcgggatggaaaagcagacagccgtaatcacacggttcctggcagactgcagatgttcctcctgctgctgccattcctcttccttcattttcctgtccggctcctccgccacaaggctggcgccgtatccggctttggatatggcctcacgtatcatgccggaagtcacctgatcctcatcataggttatcaccatccggctggtggtcaggttcacatggctgtcctccacccctcccagttttttcgtcacacgctccaccgcgctgctgcaggccgcgcaggacatgccatctatgcggtactgttctgtcctcatatcttctgctcctctcataccaggatgtgtttggattttccaacacgctcccgtatcagtatgccctgcatgaagccggtttatcaatttataaataaaaggaacctgctgttaaaagccatgtgtcatctggctttccagcaggtttcccttattaccctgttgtttttatggcatcagcaggatattctgcgtatgataatcgtatccttcaatcagatacttaaaattctcatccagccttgccatatagctgtcaaaataaatgtcccattcattgtatgaggtatggtcatttaacaggacccggatcctcatatgggaagcccccagccaggcataggaaccataggctgacggggcatggctcctgggctttgctgtctgcatatagcttccgtagcgcatcagatactggtccaggtcggttgccccggccctgtattcctgttttcccagacagcaggaaaaggtgcggtccccttccccgatttcaaaactgcagtcatctgaaagaaaggtaagacgtatgtacttatccgcatcccggaaacgtatcttcctgccattgatggaatcctggtaagcaggaatggcgttgcccgtaaccggctgtgcgtccaggatatggctcagctccaggattctttgcacattttcaggacactcttttagcggttcattcccgatacacggatatacggtttcaaaaaatgtatccagaagaggctgcgagcctgccgtggatgaattcatcacaaacgtggtgtcacaatccggcagcaccacgcacatctgcccaaataatccggacgcacggtatccgttgtgcgtacaccgccacatctgaaaaccatatccctgggtgctttctgttttataggccggataaccgggcgcggtgtctatctgcttagaggctgcaagcgcacaccattcctctgacaggatccggtgtccattcagtacacccctgttcaggaacagctgccccagcttaatcaagtccgttcccttcatgtaaaggccaaccccgccgatggaatatccggaagggtcttccagccagtcataatcctgaatcccgcacaaatcaaaaaagttttctttcaggaatccacattggcttttgcctgttatctttgtcacgattgccgacagcatatgggaggccatggaattatagtaaaaacggcttccgggcagatccgttacgcgtcggtcaaatatactttcacaccagtccctgctgtcatcccctgccgcaaacatatcaggcccatcctgtcccatggccatggtcagcagatgccggatggtaagggttcccaatccattttctgcataagaaggattggaaaaatagggatgcaccggttcatccaggcgtaacagccctctgtcatgaaggatgcccacagccacgcatgtgaatgtcttggtaaccgaattctccacatgcctgcatgtattcttatatggaaatgcattaacctgggcaatcagcttcccatgccgtgccattgtgaacgtatgtaaatggatatcacgttcttttaatctgcgaataaaggctagtatcccccgcgaatccaccccttccttttcacaggtagattgctctaattcatatgttggcaccgtaccccctcctatttcctgacaacagagaaaatgggttctcctgctgtcacttcttttcccagctgtttgttgacaactgaaaacttatcggagtccaaaaccagtatcggggatgtcaggtcaacgccctgttttttgaaatagtccatatcagcatggcataacaggtccccaacctggacctgctgtcccacggctgccttcatatcaaatccttctcctccatattttacggtatcaatgccatagtggatcataagctcaagcccttcatccgtcttcaggcatatggcgtgccgtgtccctgcaatcagttccacccgtcccggcacaggcgcgaacacatctcccgatgccggtatgatggcgcatccatcccccatcataagctgtgcaaagacaggatccctgacctcggtcatatccatggtccttccgtcaaaaggagcgcagacactgattttctttttaaatatccccaacaccttatcaccttcctacttcatcctcattatttcagttccggccagtattccttgttggcttcaatataatcgtccagaagcgccttggcaaccgtggcgctgggcacgcatctggacagcgtgtatgcctgccacatcttatggtaagagccttcctcccatgcatccaccaccagcttttccactgccacctgctgttccatcaatcccttttggaacgtgggtatccttccgatggataacggctcatagccatcctttcccaccaggcatggtatctccaccatggcatcatcatcaaagttaacaatagcaccattattgggaacaatcaacagcattctttcatgggtgttaagggccagggcaatgcacaggtcaacgataaatgtcgcatgattcgtcacctccagatagctgccctttgcagtgcccttttcggcaatttccttacaggccgtgaaaacctctgtctcccttccttccatgacctcattggcccgtgtatggccggggtctgagtgcgcaaccacgtaatccgggaaaaggtaatacttgaaataactgttgggaatcatggtggggtccaggctcaggacatcctttgccttgtaataggtatccttccagctgtattcctgctggttggatgtcatggccggtgacacaaatcccttttccagcatgtaatccctgacctttggcagcaaatcattgccggccttgtccctgatatcacaccaccatccaaagtggttcagcccaaaatagcgcacatccatttccttgcggtcattaagccctgcaatgctggctatgctgtcctccaggccaatgggcatgtcacagatgttgatgacctttgaatcaggacggaaccgcctggtggcctctgccacaatggccgctggattggaatagttgagcatccaggcatccggggaatatttttccatataatcaatgttttccagcacacctgcaatggatcgcatcccatatgtaatcccgccaggaccgcatgtctcctgtcccacgcatccatgctttaatgcaatcttctcatctttttcacgcatgggcagtttccctacccggatatgtgccaggcagaaatcgatgtccgtgtaagcctcttccgggtccacggttgccaggaactcaatctcagggtccttttccatgaccaggatcctgcatgcctctgccagctggctctgtctttcctcatcattatcatacagtttaatcttccttaacgggaacctgtcaagatgtgcaagcaatgtgcatacaatctcaggtgtgtaagtgcttccgccgcccgcaatcactactgaatactttttcattttacattctctccttaactattttccattaccttgtcaaccgtcttcttgattaatgtcacggttgtcccgtaaacaatctggatttcattgccgcttacttttacaatcccgttgcatcccgtcttcttgaggattgcttcatcaatcagggagtagtccttcacaaccacgcggagccgtgacatacatgcttccgtctccatgatattatctttaccgccaagaccccttacaatcagctgtgccttcagcatctcgggattcctggtatccagtccggccggttcccctgtttttgctgccggcatttcaatattggcaatctcagctgcaaatgccagtgaatcgtcataatctccccctcgccccggtgtctttacatcaaaatgtatgatccaccaccggaaggtgacatagcagagtatgaattccagaacggtaaccacgcagaccacccaaacattggagccgggccgcaagaatccattggtaaacaacccgatgatgctggaattagcgccgcccacaccgctgcccaggataaagcacagaaaccagcttaatccggtatagaggctgtaaaccacatagagaagcggtgccgcaaacaggaagatgaactcaatcggctctgagatggctgcgaatatggctgtcagcgccccggctaccaccagaggcttgatgctctccctcttatccgcatccgcacatttgtagatagccagtgcgattgccggaagcccgcccagcatcatgggaatctgcggcccgaaataataggaaaccagctgtgccagcgatgcgttggtgggcactccttccaccagatactgtgcatatccggcaaccgtgccttcagccactgccccggaagcaaaggtatatacacctgacacggaggtattccttacaatcgtattccatatctgatgcaggcccgtgggaatcagcgccctctccccaagcgcatagacaaagggaccgaagatgcccagactgcctaacacctttgcgaatgcatcaatcgccctctgcacatatacccagaggaacggcagcagctgtccgacaagactgagtacgattaaagatatgattggaacaaatcttgtaccctgataaaaggaaaatgccattggcagcttgatatccttaaatttgttatgcaggtttgcaacgataacacctaccaggatgcctcccatgattcctacattgacggtttccacccccagaaccgtcgtgatgcccgtctcagggaacatggcccttacggtggggaaggtcgtgattaacaggttcattgatttaagcagggcgaaataaccgataaacgcgcccagcgccgcatactctttcttttccgccgccaggccgaaggccagcgccatggcgtaaaccaatgccaggttatgaaggacctgcacgcctgtggttaccatccagttccccagatattgaatgggtgtactggcaaaaaacgggaccatcttaataatcgccgcatcagtgaaaatacagccaatggccatgataagcgatgctacacctatcagggatactggaattaaaaatgctcttgctaacttttggaaaaaagctttcataccattagacatgaatgatacccctccttatacattacaaagtgtcaatacatttacctgcgcaggctgtattttttgtattttcagtatagtgactcagacttttaaaagcaatacttccagggcatccgtgaaactcttcatactgagtaaaatagttcacgttttcagataattcatggcgtgaaaaaaccgtttatccattcagtatcatgaataaacggtttccggcagtcatacagccacatctgtattatattttaaaacttcataattgggaaaacagtaattgaaatgcaatgatggtattagatacaaacgtattaatctgcagttcatcctcccactcctctttagggatgatgacaggcagatccaccatcttcctcaggcggctgttcccgttgcgcaggaatgcaatggtaaaatatccatgctgcctgcatttttccgcttcatctatcaccagctgggtttcccctgactctgataccataatgcccacgttatccttgaactcagacaattcccccaggctttccgtatatatcagccggtagccgtccctgacacacttacggctgatataatcaatagccaccatggagtatccaactcccatggcatatacgtatttttccttagcccccttcatgtgccagatgaaggtatccaccagttcttccgaatagttactgatgatggtgttcctgattccagccagattgcggtcctgggcagcaggcggggatttgtggtcggatttgatggagaatatcaattccctgtaaccggaatacccaagtttttttgacaggttcaccaggaatgccggggatatgtagtgtctcttcgcaaaatccttaatggacatatcgctgtttttcttgatgtcttcttttatttcgtctaaaatctgccgctgcagaccattcagctcattcatctgacctactctcccctcaacacggtttgagtctattatagcataaacttttaattacaaaagaaaaaagtacgatttcccggacaggggacgcccatccccggaaaccgtacttcccaaatgcctgccttcccaaatgcctgcagggcctgtcataatgcttccgggcgtttatcgccggacggccctgaacactccctagccgttcaccaggcagtccagcctttcccccgccgtcactttcccgtattcctttaaagccaccgcttcaccggaagtaaacagcacgatggtagtcaggtccttgccttttcccttcacataatccatatccacttccaccatcaggtccccgcgttttacgttctgtccctgctccacacagaggcggaacccctggccgcccagttcaacggtatcgattccgatatggaccaggatttcctgtccttcctccgtgcggatgcccactgcgtgccccgtatcaaaggccgcggcaacggttccgtccacaggggccaggatccttccatccgtaatatcaacagcaaaaccatcgcccaggactttattggcaaacacctcgtccctgacctcattgaggggaaccagggtgcctgtggccggagaggttatttcaggcatttccctttgcattgacttctgcattgtctcctgcattgtctcctgcattgtctcctgcactggttttccagaatccgattccacaggaatgccccccttaacgtcctcatcctcctgaagcacttccttcggaatcccaaaaaggcaggtcagtacaaaacagcacgccacggagcacacggaaatgatgaaataccacagcagctggctccctttataaatatacataagataggatggcagcaccgccagtccataggaattggactggattccgagcacggacagcagcgcggcccccatgcctgaggtgaacagcataatgagcagcggccttaaattataacgcagctggataccgaacaggacaggctcactgataccaaacagctgtgaaagcatggcgccgatacttgttgaccgcacactctgctttttggacttcacaaaaaatgcaagacaggtgcccacattggcaaacccgtacatggcgcagagggtgatgacaggattaaaccctgtattggccaaaagggatgtttctatcatggtgtacgtatggtgaagccctgtaatcacaagcaggggatacgtggcgccaatgaggaacccgccgattccaaagggtagatggaccaggtgctccaccacggtcaccagctcaagctccaccacatgcatgattggaccgattcccagcatgaccaccaggaaggtccccagcatgaccaggaatggggtcatgattaaatccagggcattgggcattatcttcctcagcttcttctccatggaagcgcccacgaacgctgccaggattgccgtcagcacacttccctggcagcccacgatgggaatgcgtgaaaatgccatgaccgcgctgacgccgctgccagggtcagccaccgcgtaggcattgggcaggctgggtgataccagcatcagcccgatgaccaggccgatgaccggcatccctccaaacaccttgaacgcggaccagcagataagtgcgggcaggaaggcaaatgctgtctccgtaaggacatttaccagaatcaccacatagtccgggataatggatgaggacaggccaaaaagccccagcacattgtcattgaacacgcagccctttaatcccaggaacaggccggtggccgcaatcacgggaatgatagggatgaatatgtcccccagcatacgcatcatgcgttttacgcccgtttgctggcttttaacaatttcatcctgttcctgtttggacagtacgttaagccccatgtcctgcatttccccataaaccttattgacaatgccggtacccaggatgatctgatactgtcccgcgttgaaaaacgtccctttcaccagcccgatggctaaaagggccttttcatctatcccatccttatccttcacaatcagcctgagcctggttgcacagtgtgttgccgaaataatgttatccttcccgaccgcatttacgattgccccggccgcctgccggtactgattcccttccatcctgattccctcccgattatatgaaaatgacttcgcgtatatgtgaaaatggtactgggcctgtttgaaaactgctttccgtcagcagtgcatcccatttctatcagctgtgcgtcccgctttgtggaacatcctgcttcagcaatatggcctggaacggtttcaggcatagcatgccgtcccttatctcagcatccgtatcatttccccagatgcccaccgcccctgccgcgtcatccggcagcctctcctgtgtccctgtatgactgaaattgtaataacaccagatggtcacatcatccatctgcctctcataggcgattacattcccgctgctttcgatgggccgtatgctgccgtatatgaggcagtccctgtacggaccgtgctggcggaattgtatcatggacttgtaaaattccagcacactgtcctgtacgcctgactgtgcctcagcatggatgacaggatattccatggtcatcggcagccagggctgggactgggaaaaacctccgtaccggcttccatcccatggaaaaggcgtccttgcattgtcccggcttctcaggttcacgattctcagcgcctcatccgggtccagcccttcctccagcgaacgctggtactggtcaatactggaaatatcgttaaacagctccggagactgccgctcaaagttcaccatccccagttcctgaccctgatagataaaaggtgttcccctcaggaagaaatacatggcggccagcatcttcactgcctgcggatcatcctgtgcctccttaagatactttgtggctgcacggggctggtcgtgattttctatgaaattggcgctccagccatatttctgcaccgccatctggctgtccatgatcttcccgcccagttcccttacgttccagctgcgccgtttaaaccactcgctgcctgacgcgatatccaggtccgcataccggaaatcaaatatcatggaaaaatagccgtccggtccaatgaactcatccaaatcctcataaggcacccccggcgcctcagccacagtcacacagccgtgtttatcaaaggtttcctgtttcagttccttgaggaatgccccaatcccgggctggttcctggaacccttggtacatttagccagtccgtccaccccgtccggttcccggtctgcaaaggacaggtctttttttatgaacgtgatggcgtcaatcctgaatcccgcaattcctttttcaagccacccgttgaccatattgtaaagctgtctgcgcagtttttcattttcccagttcaggtccggctgctttttgccaaaggcgtggaaatagtactcatcccttccctccaccttttcccagacgcttccgccgaatatggagcgccagttgcagggcggtttactgccttccctgaaaatatagtaatcatggaacccgctgtccgggtgttcgagggcttccctgaaccactggtgttcgtcagacgtatggttgatgaccaggtccaggatgattttaatccctttccttcctgcttctgcaatcagttcatccaaatcctccatggttccgaattccggcgccagcgcacagtaatcggatatgtcgtaaccattgtcatccatgggcgactgatagatgggacagatccagagcatggttatccccagttccttcagataatccagcttttccgtgataccccgtatatcgccgatcccgtcattgttgctgtccttgaagcttctgggataaatctggtatactacttcttccttccaccaagttcctgaacctgccattatttttccctcctaagattttcctgatactgcgtcctacgctggtattgtttttccatatctgccctgcgttccatactggctccatgcctcatgccggccctgttttccacaccgtacggttccatggaaatgatgcctctcctcaccagctcccggtatatcccatcctccatggccgtcccgcacacagcgtctgcacgcttcctcagttcgggatccccatctgccattgccacgccgatgcccgtggacaggatcatttcgatatcattcctgccatccccaaagctgatggtgtcagacgggctgaccgccttcatcctgcaccattcacggatggcctccccctttgtgcatcctgggggaaggacctccagataccaccgcccgtccagtcctccctgctggacaatggttcctgcccgggacgccataccctccatttcctcacgctcatccatgggactccagatacagaccttgtggatggcatcatgccctggacggtaccatgccatgttgtcctcatagcggattccattttcctcccttcgcctctgcctttcccatggctccagcccttccagcttcctctcaaaatccttcctgaaccacaggctggcagctttgttcatgaatatcccctgctggctttccagtgcaaagggtacttctttccggaccaggacgtgaatcatttcctttatttcctcatattgaaaaaacagattcttccgcacccggccttcctcaagtataagacatccgccccctgcaatgattccgtccacggtcagcgcctttacatcgggctggatggaagccaggttccgtccggtgcagatgacaacctggattcccgactccctgcacatcccaatggcctgtaccgcacttgccggaatcccatgccgttcatcccgcagcgtcccgtctatgtctaaaaagactgcctttatcatccttccctccaatcagtcctgactccttcctttgttctgaacccattctatcacacaaaaaaagccccatcaataggatgggacctcttaaaacttttgtacacttatagtacatattttccataaatgaatatctgtacacatcaatatgaccgttatggcaatttcatgcagaggtaatcctgataggccaggtacagatactcaatcaggatgaagtatggggtggatatctcatactcaatgccgtaactggccgggagggtaatggagtggatatacaggttctcatcacagacagatgccagtgtattgttccccatccttgtgatggacagcatgggaacctgtctgagcctcagctcctctgccaggcccaccgttgccccggattccccggacagggagatgattaccgccatgtcccttgccgtcaccaccctggaaagggcgccccgcatgtcgtgtccgttaatatggaacatctccttcaccggaaggaagatgcgtttcatttcactggcagccctggtctgcgcggaaccgctgccatacaggaatacacgtctggccctgtgcagcttttcaaacagggaggtcatatccctgcgcatcagctcatccatcatcttgtgataactgtccgtcacaagatcaagcagttccccttcccgcctgtccccggtatcctgctcaagcctgaacctggcctttaattccccgtatccggagagtccgttcttcttggcaaaacggaccagcatggactccgacacgtggcacattcccgcaaactctgttatgctgagcctgatgcagctgtccttgtgctccagcagatacctgcatatatattgttcattttccgtaaacctgtgataattctcattaaatcgttcttccagtcccatggctttccctcatatattccagataattaacagacaggatgtccaagaggatgtaaaatgccgccaccatctcatatccggcgccctgcttaacgccctctcccccgcctatcatctttgtccctgcatacaggttataccggcacatcctggccatggtgttattggtccagcgggtgatggacagggtgcgtatatccctgcactggacaaaccgcagcacatcgatgccactttgtgattctcctgacagtgaaaccgcaatgaacaggtccttcgccttaaaattcctggaggcatactccacctcgccgtaatcaaacaggtcaatgcagcatttcccgaacatcaggaatatccgcttaaattcctctccaatcgccttctgctcattgcccgtgccaaagaggtatatggtgtccgcctcgtggattacctggcacaccgtatcataatcatatgccttcaggtcatccaccatcctgtgataaccggataggatttcctgcatatccagccgggatgccgggccgccgccggacttctcctgtaaaagcagcctgaactccgcaaacgtggcaattcccagcttcttaaacagccttaccagggtggtcctggatacatggcagtgggcggccagttccgggctgttcatctgtgtggtcctgtccttatccctcaggatcaggttcagcacttcacggtcattggccgtcagacgctcataattctcatttatccttttttccagatccatatctgagggttcctcctacatggccttctgaagcagccgcctgaacacaaacagcacaaccgcgtaaaaggccgtcactatcataagtgtcttggatacggtcaggctgatgaacccgctgaccaggataccgatataaagggtaagcatcatggtatatcccgtatatgcccagcatcgcagccccagcatccggttcctctcatccgtctcataaatcttctgcttcttccccagctccggattcttcaggtacttcacattcctgatgatggaaatgacgcccgccgccacaagcccggcccctgtccctccgtaaaaccccgggatataatccgtatatcccggctccaggtacattaccatcacccggttcctggccacaaaggacagcaccagggccgccgcccccaataccaggaacatgacaccaatccacacccggttcctgcatctcttctcaaaatcaataggactctcaataaataaccggttcagccacataatcattcctcctcatataaaaatatttcttctatgcttcgttcaaaaaacctggcaatcttaaacgccagctgcagtgatgcattatacttgccgttctccagggaaatgatggtctgccgggtcactcccagcgcggccgccagttcctcctgggttaccttgttctgtttgcgcagttcctgtattttagtcttcaatcccaccaccctttcatccttaaaacctggaggcaaaaaatgtaaagtaacttttacttttttagtatagtttactttacattaaatgtcaagcttattttacatacttgtttaaaaaaggaactgccacagtgtagcagctacttataacccccttatcatcacattttgctttcaatatattaaacaaacccgattcattttcctgttcccgaatgtatccaatcttatctatcggccattccatatcttttgatctaataattttctccttgaattaaaatatcatttaaagtaatgattttactgcccttactttcataatagcgcagcatttcgtcaatttttcttttgtcataactggtaatgcaatctgataagacattaaccttataattggctttacgtaagttataacaggttgattttacacaagcggcggcgtctgctcccgctatataaaaatcacatatatcatttttactaataaaagctgcaaatccttcactggttaatgcatttcctttgcatttcgtaaaaacattttttgacactattttcaggtctgaaaccaattcagctcccggtgtgccgggcttaaatgtccttgttccggctgataagttttcatgccttatataaataacatgaatcttattatcgaccgcccaatcaaccgcctgattgatattgccaatcacatctttgtaattctttgttatgtcgttttgaatatctattattactaaagcttttttctgcatactgtttcctccaaatggcagattgatttgttttcttttttattatacaatgtaatcgttgacaacagtatggcaacaattaaaaaatcaaacggcggtgggcagatgaaaatagacaggcttgttagcattatcatgatactccttgataaaaggcgtatcggcgcacaggagttagcagatatgtttgaagtttcaccccgcacgatttaccgcgatatagacgccatcaacatggcgggtattcctgtccgcggggcatcaggagcaggcggcggctttgaaatcatgccggaatacaagattgataaaaaggtattttcggccgccgacctttccgttctcttgatgggtctttccagtctttctaacatgatacggggcgatgaactggtatgcgctcttgccaaagttaaaagtttcatccccgccgacagggcaaaagacattgaactaaaggtaaatcagatatgcatagatttaagtccgtggacaggcaacagaaacatacaaccatatttggaaatcatcaaagcagctttgcaggaaagcaggctgctgacctttgaatatatagcccaccatggaaataaaaccgagcggacagccgagccatatcagcttgtattgaaaagcagtcattggtatttgcaaggatattgccataaaaggaatgctttccgcttattcagactatcccgtatgtcaaacctgcaaatacaggaggaaacttttacaccccgggattatcaaaaaccaactttaaactttgcggaaatgtgggaaacaatgcagacaagaatcaaaatccgtatccataaatctgtcatggacagggtgctcgactactgtacttatgatgatttttcaccagatgggaatgagcattatattgtcagctttcctttcattgaaaacggataccactacgatatccttttaggttttggaaataaatgtgaatgtttggaaccgttacatatccgtacggaaatgaagcgcagaatccatgatatagctgccatgtatgaaagttgatacacggagaaacggcatagccgaagctacgccgtttcccgaaaatattccgatgctgttttatcagtgccgcctttgtgacggcgcctttttacacatactagcccacaaatttggaagcatatccctggatgaagatacccagtacaatcagaggcaggatataactcacataaatccttgcccaggcaggaaaatggattccctccccttcattggcctccgccatgaacttcttaaatccccaaccataccggctggtgcagaataaaagatacagcatgcttccgatgggaagcaggttattgctgaggatgaaatcctccaggtccaggaccgtgcttccttcgcccagcggagcaaaaccgctccacaggttgaatcccagcacacacgggatggacaggatgatgattaccacgatgttccatacaaccgcctttctgatggaacagccggtcaggtccgttgcaaaggatatgatattctggaacaccgcgatgatggttgaaaatgccgcaaaggacatgaacaggaaaaacatggtcccccatatcctcccgcctgccatatggttgaatacattgggcagggtgatgaaaatcaaggcaggccctgatttggactcaatgttataggcaaagcaggcagggaagataatgagtcccgccataaatgcaaccatggtgtctaaaagcgcaacactgaccgcctcccctgtcagggaccgctccttgccgatatagcttccaaagatagccagggcgccgattccaatactcagcgtaaaaaaggactgtcccagggccgcgaacacggcttcccccaccccggcttccttcatcttgccgaaatcaggctttaggtagaactccagccccggacctccgcccggaaggatcatggaatggacagccagcacaatcatcagccccaaaaggcacaccatcatgaccttggtaatgcgctccaccccctgctgaaggcccatggcacacacgccgaaacacagcaataccacgaccaccataaagcttcccatcaatgcggggtttcccagcatggtgttaaattcccctgccacggcctctgcctcaaggccggcaaagtcacccatgagcattttgaaaaaatagaggaccatccaaccgccaaccgtggtgtaaaacatcatcaggatatagttgcctgccatggcaggatactttgtcagatgccatttactcccttttggttccagcacatcaaaggacagggccgcgcttttcctgctggcccgtccaaccgcaaactccattactacaatcggcagtcccaatatcagaaggaatgcaaggtagaccagcacgaatgccgcgcctccgtattcacctacgatatatgggaaacgccatacattgccaaggccaatggcacatcctgcggatataaggatgaagccaagcctggacgaaaatttttcacgttccatgattatatatcccccatctcgtaataaaagcgccttctaccagagcagcttctaaacatgctctcagggcgctttcatatattaccatattatcacataaatagcaaccatatgaaaccacccaaaccactttactagagcctgtttgattagggtttatcaagtaaagtgtgtaaatttttaaattttctgccagaggtcttatgacctccgatgtatagatgtatattatggcttttgattcctttggcagagaatggctttgtggtgctgctcggtctgctccatctggcatttggtaccttctgggcgatggctgtctttgcaaactcaatggttaatactccatcgattacctcaactgccctttcaccccctgctctcattctctgtcattgccgtgtcctccttgatttattgtatcaaccttatgtacttattatatacccgatttgagttgatacaattagtaagaggtgctatagtagaaacagagttaaaactatatgctaaaatacaaaattgacattcttgctgcattaaaagaaaatgaatatactacttatcacatacgacatgagaaacttattggcgaagcacaaatgcaaaaaatccgtaacggtgaaattgcaagcaaggaaacgcttaataaaccatgtgaatcgctcaactgtcaaccaggagatttgttggagtatatagaggaagaccattcagcaaaaacataatgaaataagccccgagactcaattcgggacagcagaatgacaatataatatacttaccaagggaaccgatggggcgatatgtccagccacctacttatacaaaagaaaggggctggtgctcatgtatgttacatatggcgatttattcacctttgtaattatgctatgcgcagttataactcttgtttatctgcataaaaaatagcgcccccacctggacagtgtagcgctatttaagtaattatacaccgaggtggctaggctatatctagtcatcggttctcttgttaagtatattatatcggttcgccaaactattgtcaacacatttttgactggctacctaaccgtaacggctatgatacgacagttggctttccaggctctatctgttatcctaaaagctgctacccgacgcacaaaaccgcaaccttttgagggctgcggttcttgttttttagtgggcaggtataaggtaagtatatccatatagaaggatctcgggattttgtcatgactgccagcattttctccagttcattaatctttatatccccaaaaatcttggcatatagcaatttttgcctgtcctttcggagctgacctgacataatccgaagcatggtctgaaccattatctttttccagcccgtgcaaacataatagcctgctgacagatatgtctgacgtgtatctctaaaagtgtcacaaaacctctcccatgaaaaatatatccaacatcagagcctgtttacaaactggcattttacaaaaagagaacatccactacgattgattttaaaatctaaatcgaactcctatctctgtcccttatcatacggcacgccggatgcccgcggcgcctgggaattcctggaggtgaatacaagtacaatcagggtggccagatagggaatcatcttatacacataacttggtatacccgtggctgcaaggaaggggataccggaataagccgccgccaccgccttcataaggccgaagaacagggatgcccacatgatcctcaccggcttccattgcccgaatataagcacggccaatgccaggaaaccatatccggccacgtccgcattaaagttggtggaggtcgggaccacgaacaccagaccgcccaggccgcccagcacaccggatatcaggactcccgcatactgcatcctgtacacattgattcccgccgcgtccgctgcctggggatgttcaccgcaggaacgcaggcgcaggccgaacctggtgcggtacagcacaagggtcgaaacaatcaggatcaggatgcccagataggtggtgatatacgtattctggaacagcaacggtcctaagaagggaatccttccaagcaccggaaccgactcaatgcggaatgtattattgaactgtatctgctggactccctggatgacccttgccacaaagatggcgaatgcaggcgcaaacatgttaagcgccgttccgctgatggtctggttggccttcatattgatggaggcatatgcgtggaaaaacgcaaaagccgcgcctgtggccgttgaaatcaggatggccaggaacagctggagctgcccgcccatctttcctccggtcatgttcaggaacaggattcccgtaaatgcccccatggtcatgataccttccagggcaatgttcacaacgccgctgcgctcggaaaacatgccgcccagcgccacaatcatcaggggaatcgtaaacagcatggtctgctggaaaataaagtatacaacactcatgactgcccgcctcctttctccctgttcttgttgacacgggtcaggatggtcttcacaatcagtgcaaatgcgctgaaataaatgatgactgcaacgatgatatcaatgatttccgtggaaaattcaaaaagctgcagatagaatccgcccgccgtcaggtaggcgataaaaatacccgagaacagtacgccgatgggatggctcagtcccagaagggccacggagattcccgtaaagccttcggacgccagcacatcctttatctcaatgtgcttccctgtcccggccaggtacaaaagcccgcccgccataccggctatggcgcctgcaatcaccatgctcatgatgatgcttttcttctcattaatgcccgcatacttactggcatcccggttaaaaccaaccgccttcagttcatatccgaaggtggtcctgttcaggatgacccagataaggatcacggttgcaatggcaatcaggattcccccgttcacactggattccgggaacaggcggtccatgcccatcttgggaatctgggccgtggaagccacgttcctggattcattcctcaagttattaaacaggggtttatagctcttcacaatccagttaaccatatacatgccgatgtaattcatcatgatggaggcaattacctcatttacattaaaatatgccttcaaaagccccggaaccataccccacagcgcgccgccaaggaccgccgccagaagggccgctgcccagtggacaggccccagccccttccacatgatgcccacatagaccgccgcaaatgcgcccacaatgaactgccccggcgtaccgatattgaacagccctgtcttaaacgcaaatcccacggaaagaccggtaaggataatgggcgttgcataatagaacacctgccccacgccctttaagccgtgggtcaatgcgcctgtaagtatggtaatgaatcccggcactgcctgggaaggattactgaaaagcagtatggcaaatcccaccagcagtccgatgatgattgcaaatacggaggataataccccaacataatcgcgctttttccgtgtcttaggcctgctcatcatgcatcacctgcctttcctggagtatcgctgccttctgcatcttctccctgtacatcctggctctccgcgccatttccctgtacatcccggccttccgcgccatttccctgtacatcccggccttctgcgccatttccctgtacatcctggccttcttcatcacgcccggccgtcatatcctgccgcttggaaccagccatgtaaagccccagttcctggaccgtgacctcgcccgggtcaaggtccgccacaatcccgccttcaaacatcacaaggatacggtcgcttaagttcatgacctcatccagttccagggatatgagaaggatggcagcgccctcatcccgctgcttcacaagcatctggtggatatattcgatggcgcccacatccaggcccctggtcggctgcactgccagaaggatatcgtggtccctggaaatctcccttgccacgattgccttctgctggttgccgccggacatgctccgcgtgaccgtttccgcgccttcaccgctccggatatcaaagtcggcaatcagccggtccgcatatctgtatatctcatcatcctgcaggaaacccgccttctggaacccaggttcaaaatactgctgcaggaccaggttatatgccagattataatccagcaccaggccgtgtttgtgcctgtcctcagggatatggctcagaccggacgtgttcctgtgccgtatgctcttcttcgtcacatcctcgccgtttaacaggatccggccccgggcagcttccccaagcccggtgatggcatggaccagctcggtctgcccattgccgtcgattcccgcaatacagacaatctcaccgctgcgcacctcaaagcttacatcgttgaccaggagcttggtatgtccctctatgtgggactgcaccgatacatgctccacttccagtatagacctgccgggggacgccggggtcttctcaaccgtaaggcttaccttgcggcccaccatcatctccgacatttcctccttggaaatggaggccacatcaacggtacctatgtatttaccgcggcgcagcacggaacaccggtctgccaccgccttgatttcatccagcttatgggtgatgaacaggatggacttgccttcggccactaagctttgcatgatctccatgagctcgtcaatctcctgtggcgtaagcacggcagtgggttcgtcaaaaatcatgatttcattgtcccggtaaagcattttcaggatttccaccctctgctgcatccccaccgtgatatcctggatcagggcgtccgggtcaatgtacaggccgtaccgctcactgagtcccactacctttttccttgcatcatccattttcaaaaatccatgcctgaccgtctccatgcccaggacgatattctgcaggaccgtaaaattatgcaccagcttaaaatgctggtgtaccatgccgatgcccagggcattggcatccagggggcctttgattttcacttcctgtcccctgaccttaatcacacccttttctggctggtaaagcccgaacagcacgctcatcagcgtggacttacccgctccgttctcacccagcagggcgtggatttcccccttcttaagctgaagggtgatattgtcattcgctataataccgggaaattcctttgtgatgcccagcatctcaataatataatcgtccatgcggttccccctcgcaacaaaccagcctgtgcggccttgccttcaccgcccggcgggatgaaggcctgaaaataccacagggcgccgttgttatccggcaccctgtgtgtcaatgaagcttcagccgcctctcctactctacatatgtgactttggtgttggtcaatcccgtcagatcctttgtcgggtcattgttgtcctctgagaactgtaccagcgttatatcgccgtcagccagcttcttatatatggcatcatactgctcctgtgagaacttctcaaacttggaggtctccatgggaagtccgacgccgttattcccaaccgtgaacacggaggtcttgccgcccgggaacctgccatcgtagaaatcctttaccccgtcatatacggagttggaaagcagcttcatggcagaggtgatgaccgtgtcggattcactgctctggtcaacgtccacgccaatggttttggcattcttctcctgggccgccgccatcacggaattgcccacggcgcctccgcagccgaatatgacctcggtgccgttctgataccaggaagcagccatggactgagcctccggggtagctgcaaatccgccggtataattgtacatgacctcaacgcctgtgatgccgtcttcctcggcagcaaactcagcgccctggacaaatccgtagccgaaacggatgacggccggaaccgccatgccgcccatgaagcccagctttgtatagccgtccttcacagccgcatatccggccaggaagcctgcctggtcctcctggaacaggatgggcatgacattatcgcctgtcttgtaattatattccgcatcatgaggctccccgtccagcaggatgaagtggacgtccggatacttatcctgggcaatgtaaatcggctcctcaaacaggaaaccggggcataccaccagcttcgcgccgccctctatggccagtccgatggtttccaggtaggcgtccgtggtgccttcctggggctggtaatacttatatgtgatactgttctcttccgcatacttcttaaggccttcccaggctccctggttaaaggacttatcgtcaatggtgccaaggtcggtgaccagggccagctcatagccgcctgactgggatgcagctgcctccgtggccgcctcaccctccgtcttgccctcgtccttgctctcagcagccggtgcttctgtcccggcaggcgcctgtgtcggctctgtcttcggtgaaccgccgcatgctgccagggaaccggccatcactgccgccagcgccattgccaatattctttttttcataagcttgattcctcctcttcgattccagatgaatagtgtccaagtacatttctaatttaccataaattacaaattattgcaatattttaaggaattatttgtaaattatgccgaacatgttgaaaaatgcacatacacatcccaatgtccattacaaatcaaacagggacagctggttggaacggggcaggtccttcagcagccccatatccgccatcagggtgcacagggtgccgtttaccttggccctgctgctgaaatcctcaatggacaggaagatgccgtcctttaccgcatccaccactgcgtccgcagctttctcgcccagtccgtcaatactgctgagggaaggcatcagcttgccgtctatgatctggaaatgccttgccttggccctgtagatatccaggggcatgaagtcatacccccttgcatacatttcctggacaatacgcatgtccctgagggtgtcctgctcctttttagaaagggtatccgcccgcttcttatagtcagccagataatattccagcttatccctgccctggcacatgatttcataggaaaatgcgctggcgcggatactgaagaacgcggcataataggccagtggataaaatatcttacagtaagcaatacgccacgccatcattacgtaggcagccgcatgggccttgggaaacatgtatttgattttcttacaggaccagatataccagtccggcacgccgtgggccgtcatctcctcctcccactcaggcttcagccccttgcccttacgcacgctctccatgatggtgaaggacaggccctcttccaggccttgggcaatcaggtaaaccatgatgtcatcacgcgtacagatggctgtctggatggtggcctttccttcttggatcagggtctgggcattgcccagccatacgtccgtaccatgggcaagcccggcaatacgcaccaggtccgaaaaatacttgggcttggtgtccagaagcatctgcatggcaaaatccgtgccgaactcaggcaccccaagggcgcccagtggacacccgccgatgtcatcgggcagtatcccaagggccgaggtgtcctggaacaggctcatgacctcccggctgtccaaaggaatatccttaaccgggtcaatgccgatcaggtcctgaagcatacgtatcatggtaggatcatcgtgtcccaggatatccagcttcagcaggttatggtcaatggagtgatagtcaaagtgtgtggtcaccgtggaggtggtcatatcattggccgggtgctggaccggggtaaaggaataaatctcctcccccaggggaagcacgataatgcccccggggtgctgtcccgtggtacggcgcacgcccacgcagccctgcacgatccggttaatctcacagttgcgcttgcgtgtgccccgctcctcgtagtacttcttcacgtaaccgaaggccgtcttatccgccagggtgccgatggtgccagcgcggaaggtctgcccctttccaaagatgacctcggtgtaatcatgggccttactctggtactcaccggagaagttaaggtcgatatccggctccttatcccccttaaacccaaggaatgtctcaaaggggatgtcaaatccgtccttctcaagaggggtcccgcacacgggacaggacttatccggcatatcgcagcccgccataccggagaacttccttacctcctcggaatcaaaatcataataacggcagttgggacagtggtaatgggggcttaagggattcacctccgtgataccggacatggtcgccacgaaggaggaaccgaccgaacctcgtgaaccgaccaggtaaccgtcctcattggacttccacaccagcttctgggcgatgatgtacataaccgcgaacccgttggtgatgatggagtgaagctcccgttccagacggtccacaacaatctttggcaggttctcgccgtacatctcatgggccctgtcatagcagatcttggtcagggtcttatctgaatcctcaatcacgggcgggcacttgtccgggcgcacaggcgcgattttctcacacatgtccgcaaccttcctggtattggtcacaaccacctcatgtgccttatccggtcccagataggaaaattcctttatcatctcctccgtggtccgcagatacaggggcgcctggtcatcggaatccttaaagccctgtcccgccatgatgatcctgcggtacacctcgtcctggggatccaggaaatgcacgtcgcaggtagcgcataccagcttattgaactgcatgccaagttccacgattttcttattgatttcaatcaggtcggcttccgatttcaccgtgctcttctcatcccggagcatgaaggagttgttgccaagaggctgtatctccagataatcatagaaattcacaagccttgcaatctccgcgtccggcgcgccgcgcagcagcgcctggtacagttccccggcctcgcaggcagaaccgatgatcaggccttcccggtacttatccaggatactctttggtatcctgggccttctggcataatactccaggtgggaccagctcaccaggcggtacaggttgacacggccgatatcattcttggcaaggatgatcacgtggtatgtaggcagcttgcggatggtattcgtatccatggtgctcattccgttgagggcttccaaatcagtcactccccggtcccggagcatcctgacaaacgctgcaaatatctcagccgttgcacctgcatcgtccaccgcccggtgatggttggccagggagatattcagcgcctttgccactgtatccagcttaaagcggttcaggttgggaaggagcagccttgcaatggtcacggtatccaataccgtaggattaaaatgcagtccctgttcctctgcaaaatggctgatgaaccccacgtcaaagctggcgttatgggccaccaggacggcatcccccacaaaatccaggaactgcggcaggatcacatcgattttggggtacggaagcaccatggaatcgttgatgcccgtcagcttctctatgtcaaaggggatgggcacatccggattgacgaaggaggaaaaacggtctgttatctttccgtccaccaccttcacggcgcctatctcgataatcctgttcttcttggggctgaaacccgtggtttctatatcaaacaccacaaaggtatcctcaaagccctgcccccccggattctccaccagctgcttcgtatcatccaccaggtagccttccaccccgtatatgattttaaacgtgtcccccttatccagggcatggttggcatccgggaaggcctggacacatccgtggtccgtcaccgcaatggccggcatgccccactgtttggccctcttgatgatgctcttgacctcggacacgccatccatatcgctcatcttggtatggcagtgaagctcaatcctcttatccaggctgttgtccatgcgcttgctggtaaaatcatctgttttcttgattcccacaatggatcccagggtcagttcgccgtcaaacttgtcaatggtggtcacacccttgaccttgatgaagatgccgggactgataaccgccttgacctcgtcaaaaagctcgggacggatgaacatcttcacggttatggtatccgtaaagtcgctgacatcaaaggtcaggatgaacttgccgctgcgcagctccctgttctcacaggtaagcaccttgccccttaaggtaacctccccaatctccccgtcaatcttctcaatctccatgggttcgtcctcaaagtcacggccatagagcacatccgggttattggaacgtttgaccgaatacttcttatcctcgccaaacccattatccctgtccttgccccagcccttccggcccttgttaagctgcggcttgtccttttgcccgcctgcctgtttcaggccggacgcctgggcagcgccctttgatgaggtcccgtcaaagcctgctgcatttccctgtcctgtatctccatcgcttcccacgtcgcctgccgaggcctgggccatgagcatgtcccagggcgcgctttcaggcacgcctgcgcctggatccatgaagccattgcctgcatttccctgtcctccggttccctggaccagctcctgtccctccaggccttccgttgaaaaggaaccgcccatggcagccagttcctccttgtggttctgccagtagatggcctgggcttcccgctccatcttcagttcaatctgccttctgcggtcattgccctggggcggcacaaaggtaaatcccacctcaaccggaaggccgcagcgctccgtaaacaccttctcgatgacgcgctttagctcccctgtcctgtcccggttcaccatggtgtcctccacggacaggaccatcaggtcttccttgtcaaagttaatctgtgccttccggaacatggtgtactcaatgatgctgtagttcttaagttccagcagtaggctctccttatacatgtccagcagctttttaggggtatactggtcggacagcctgtatttttcctgaatcttgatggccacctgtttgtccgggaacagctggtccttaatccccttttccaaatcatatatattctgtttatgtatgagcctggggcttttcagataaatgcggatagagcttctatccctggtggtggtcaccttttccacctgcaccagacctaaaagctcttttaagggttccgcaatctttaaagttggaaatacttccagaaaacactttgccatatatccctgcttctttctataacttaaacctgtttttgcatggcttccagttccgcgcgcagcacggccagcagatgttcctccggcaccttgcgtatgatttcgcctttttttatcagaaggccctctcccacgccgcctgcaatcccgatatccgcttcctttgcctcacccgggccattgaccacacagcccatgacagccaccttcacatccaggtcatcaaactccgataccatggtttccacctggtttgcaagcccgatcaaatcaatgcgggtccttccgcaggtcggacaggataccacctcaataccgcctttcctcagacccagcgtgcgcaggattagctttgccgtcttaacctcctccaccgggtcgccggtcagggataccctgatggtgtccccaatgccctggtgcaggatgattcccagtcccaccgaggacttgatattgcccgaataaagggttccggcctccgtgatacccacgtgaaggggatatccggtcctggctgcaatcagttcatgggctttgacacacatcatcacatccgaggacttgatgctgatgaccaggttgtcataccccatgtcctctattaatttcaccttgtcaagggcgctttccacaataccatccgctgtcacgcctccgtacttttccagcagcggtttctccagtgaaccgctgttcacccccacgcggatggggatatcccgcgccttagccgcatccaccactgccttcaccttatgatggtcaccgatattgcccgggttgatgcggatcttgtcagccccatgctccatggccccgatggccaggcggtaatcaaaatggatatccgccaccagcggtatgtgtatctccttttttatgccggaaagggcaatggcggcttccatggtgggcaccgccacccggatgatgtcgcagcccgcctgttccagacggtggatctgctccaccgtcgcccttacatcttctgtttttgtattgcacatggactggatcaggatgggattcccgccgccaatgacacggcttccaatccgtattgtctttgtatggttcctgtacatgtttctcccttccttttgcatcttgctgccggtcagaacagcttcctcacatcgttaaacaggataagcaccataagggccagcaacagcatcattccggccatatggaccatgccttccttttccttgtcaatgggtttacctctcagggcttctatgataaggaacacaaggcgcccgccgtccagcgcaggtatggggagaaggttcatcacccccaggttggcgctgagcagtacggtcagctgcaccaccatgaggataatggccatggcacctgcaggcgccaccgcatccaccgtcttgtcaatctccaccacgattcccacaggaccgctgatatcattgaggcttaccatgccccggaccatcatggacagggtgtcaaatacatattgtatctggaaccgcacctgatacagtccctgtaccagcagttcgcccggattctgcacagccctcggcattgcatcaaatcccacgcctatgacgtagctgccgctgtccttaacgtagattggcgtaaccctggcgctgtgggattcctccttgcctgacgggtccgtcctgtgccaggtcaggtcaaggtccttctgaggatgggtaaacagatacgccttgaactcatcaaaggaatggaccttcctgccattgacggatgttatcacatcccctgcctggagtcccgccagctgggccggatacccctcggtcacgctgaggagcttcgtggtattgtaacccagcgcgcctaccaggaccagggacaggagaaatgcgagaatgaaattaaaaacaggccctgctgccaccacggatatcctggtccacacggacttgttgttaaatgcatgttcatccgaatcattttcatcctctcccagcatcatacaggagccgccgaagggcagcgccttaaacgaatatctggtgccgcctttttcacagctccatatcctggggcccatccccagtgaaaattcaatcacaccaattccgttcagctttgcaaataaaaaatggccaaattcgtgaatcattataatgattcccagcatcagcaccgctataatcagactcatccggcaataacctttctgtcttaatcactgtttttacattctatgcgttccatctgtcctttataaacccatatgtctcctgttccgctttaaggattccctccacatccggatcagcctgcaccttatggacggccatggcttccccgattatgtccacgatgtccagatatccaatcctgccatctaaaaacagggagaccgccatctcattggcggcattgaataccgtgggcatggagccgcccttccgtccggcctcataggccagtttaagcccgcggaaattctccatgtccgggactgagaattcaatctgcctgagttttgtaaaatccagcctgccgccaggaagatggcgccgctggggataatagagggcgtactggatgggaagcttcatatccggggtcccgagctgggcaattactgccccgtcctcaaactccaccatggaatggatgacgctggtgggctgtaccaccacctgcacctggtcaaggtccacatcaaagagccagcgggcctccatgacctccagccccttattcaccatgcttgaggaatcaatggtaatcttatggcccatggaccagttggggtgctttaaggcatcctccaccttaactccagccatctgctccctggtccatccccggaacgggccgccggaagcagtcagaagaatcttatggacaggattgcccgccgccccctgaaggcattggaaaatggcggaatgctcagaatccacagggagtatcctgacaccggccttctctgccaggggcatgatgatatggcccgctgtcaccagtgtttccttgttggccagggcaatgtccttgccggcttccatggccgcgatggtcggacggattccaatcatgcccaccacggcagtgaccaccatctcagcagagtcctccaccgctgcctcaatcaggccttccatcccgcttaccaccttcacatccaggtccgccaccagggtccttagaagggatgccttttcctcttcccacagacaggccagccttggcctgaactcccgtatctgctgttccatcagacgtacattactgcccgctgccagggcagtgacgcgcaggtcctgattgtatctcacaatatccaatgtctgggtgccgatggaaccagtggaacccaggattgcaatgttcttcatcataacttatattctccctatcctgaagaaatactcttcttattcatttattttaagaatgtaagggcaaaataaatggcaggcgcagtgaatatcatgctgtcaaaccggtccaggatacctccgtgccccggaatcagccgtccgtaatccttgattccatggttcctcttaatggcggacgcagccaggtccccaatctgggatatgacggccgcaatggcgcatgcaacggcacagacaagctgggggttatccaccccggacatgttcctgccgaaaaaagccgcatagatgaacccaagaagcgcggcgcccgctgctccccccacggccccctcaatggatttcttcggactcaggacaggggccagcttatggcggcccagcagcatgccgctgcagtaggcgcatgtgtcacatccccatgagcttaagaaaatcagccagaccagataggccccgtcattcatgacccttgtctggtagaggaaggacagcatcacaggcacataacacacgccgaaaaaggcggccgtcacttcttctgtcttatactttggaaatgtaaacacgtaaagcgccatcatcaccatcagtgatgcaatgatcattaatgtgatgtacttctgtccctcaaaccacaggatcccgtaataggaacacgccgtggcgtaccccacggccgccagggatttccgctcaatgccaagcacccggtatagttcaaacaggcctatggcggaaatcaatgctgtgacgccgaacagaagggcgccgccctgtccgacaaccacaacggacagaagcaccagtatgattccgcttatcaatcgggtcgtaaacatggccctctcctttcccacatcccaacacatctttgctcaggaccttccgctaatacatacggaaaatcagcgcctgcgcaaacatggactggttattttaccgtaccgaaccgccggtctcttttattatactgcacgatggctttttctaattcctcctgattgaaatcaggccacaggcagtcggtgacaacaatctccgtataggccagctgccacagcaggtaattggaaagcctgagttccccgctggtccggattaaaagatccgggtccggcataccggccgtgtccagataagatgaaaagagggactcgtcaatctggtccgtatccaccttcccatccgcacagtcctttgccagcctggccgccgccctgcgtatctcgtcgcgcccgccgtagttaaccgcaatcacaaaggtcagtcccgtattatcctttgtctggctttccagacggttgataccctctatgatgtccgccgcaaacctgctcctgtcgccaatcatcctgacacgcacattattggcagatgcaatcttcagaagacgcaccatataataccggaaaagctgcatcaatgcccccacctcttcggcggaacgcttccagttctccgtggaaaaaccatatacggtcaaatagcggattcccatcctcgcagctatctccaccgtcttctccaccgtgacgcaaccttccttgtggcccatggtccggggaagcccccgccttttcgcccatcttccattgccgtccagtatgagggccacatgccccggtatcaccatattttcatctaatgccatacttatccgcctttcctgtgtactttcccggcaggtccttccctacttcccaaccgttcctgccatacttcctgacaggtccatctgtactcctcaaccggttcctgccatacttcccgacaggtccttctgtaatcctcaaccgttcctgccgcacttcccggcaagtcctgccacatttttcctgaaacatcctgcctgtcctgccattcatgtgaagctgccgccagccggctgtgccgcggcccattacatagaacaggaggcaggagtccctcctgccccctgtattcacttatatggattaaactgtcatgatttcctttgtcttctcttcaacagccttgtctactttctccaccatcttatcagtcagcttctgcatcttctcagttgcctccttcaggtcgtcctccgacatatcccctgccttctctgctttcttaaaagcttcattggcatcacggcggatattgcgcagcgctaccttggcgccctcaccctttttctttacatccttggaaacttcttttctgcggtcctctgtcatctcagggaatacaagtcggatgcagttaccgtcattggttgggttgattccaagttcagaggtcaggatagccttctcaatgggttttaagaggctcttctcccatggctggattacaatcatgcgggcctcaggaacagagacattgcccacctgctggagaggggtcggcgtcccgtaatagtccaccttaagcttatccaacacatggggattggcacgtcctgcccggatggttccgaagtcagataacagcacatccagcgtcttattcatcttgtcctcataaattttcagttcttccataagttcctcctgttaatgcagtcttgcctgctgcttaatattgttccttcccactttcaaatacaccctaagccgtcacaatggtgccgttgatacgcccctgcattgcattggcaattccatcctgctcattgagactgaataccgccatcggcatcctgtgctccatacacatgatggatgcagtaaggtccaccacggccagctgcctgtcaatcacttcctgtatggagatggtatcgtacttcttagcctgcggattaatcttcgggtcactgtcatataccccgtcaatggccttagccagaaggatacagtccgcgtccatctcaatggccctcagcgcaatgccggtatccgttgaaaaatacggatggcctgtcccgcctgcaaagaaaaccaccatgcccttctcaaagtacttattggccctgtccttggaaaacagtttagtcatggagccgcactcaaagggggtcagtatctgtgtcatcatccctgcgccccggaatatttccgacacatagatgcagttcatcaccgtggccagcattccaatctgatctgcctttgtccggtcaatggcctcgctggtacgtcccctccagaaattacctccgccaatcacaatacctacctgtatacctgcgtctacagagagctttacctgcctggccacttccttaaccgtcccttcatcaaaaccggtttttttaggtcctgccagggcctctccgcttaattttaaaaacacgcgattcatcttcataaagccttttctccttgttgcaatatctgtcgctattataacatagttaggtcaatttgcaaagaaaaagaaattatttctgtttttttccttttcgtctcacatttcataaataaaaattgagattttctggcttttatattataatggaagaaatgcaattgcaggcagtctgctgtctgtgaattaaaaaggaggaaacaatcatgggtttgtttcagcacaaaaaagataaaaccacggcagaactgccgcccacaccacctgcattcactcctgcggagccagctggggaaggaagggccctctgtctgcaaaggctggaggaagtcttgggagccccctcttccaagggcgttgtcctgaaactttatttggaaaactttaaaagcctgaacaagaccttcggttatgactactgtgaagaacttctttcacagataaagggatacctgggtgagatggccgagggtaacatataccgctacataggcgttgagttcatcatcatcctggaacaatacagcgaaggccaggcttctgatttggcggatgagatactggaacgttttgagaatgtatggaagatacgcggcgtggactgcctgtgctctgcacagataggtctctgttcctatccgggccatgcggctaacgtggacgagcttcttaagcggctggaccttgccgttgcttctgccgccgaatgcggccccaaccagatgtccgtgtatgacagcaacatgcatacgcagtttgtgcgccgccagtccattgccatgtatctgcagaccgcactggagaagcacgaactggaagtccgctaccgtcccacctactgtctgaaggaaggccggttcacaagggctgattcctacatgcggatattcatccagggaatcggtcttgtgggcgccgctgaattcctgccgattgcagaagactcaggacagatccgtgccattggatactatgccctggaccacgcgggaaagagcattgcagagctgcttgcctcgggcagtgaatttgattccatctgcatcccggtctcccctatccttctggtacaggaggatttcatagaccaggtaaagcgggtaatcgagacctaccagattccggaaggcaagctggcgctggaggtggatgacaccgccctgtccagtgtatacctgaatgtgaacatcaccatgcaggagctgtacgatatgggcgtggaactggtcatgaacaacttcggttcaggctgcgcacctgtgaccagtatcctggaccttccggtcaacacagtcaagctggagcgcatgttcgtatggcagctggaaaccaatccaaagtccgcgtccattgcaggcggattgattcagattgcaaaggagctgggcatacatatcattgccgagggcgtggagacagaaaaccagctgaatgcgctcaacagctacgaatgtgaataccagcagggcttctactacgcccctaccatggaattcgatgtacttaaaaaggtacttggaaccacattggatgagtcacgggtaacgattgaggaagaaaagctgaagatgaagagataggcaggattgacggttgatatgtaaaatgaatatatgattatataatgcaggctgcccggtaaatgagtaccggacagcctgtgtctgtgtctgaatctgcagttctgaatctgtgtcttcggccctgcatctatgtcttcggccctgcatctatgtcttcggccctgcacctgtgtcttcggttttgtatctgtatcttcggttttgcatctgtgtcttcggttttgtatctgtgtcttcggttttgtatcagcttcatcaattcccatcttccgtatccgtcacgacatgtacatgccggtacgggatggaaatgccttttgcatcaaaattcttcttaatcagcctcctgatatcgctgcaggctgcgaaattatcgtcaagattcctggtccataccgtggccttcaggatgattccatcatctcccagctccttgacagccacgttcaccttattcccttcggtctggtccgtccggatatccgtcaccaggggatgggatgcaatggtatcacgcatgacttccatggctagttccaggttactttcatagctgaccgctatttccatataattaccgatataatcattgttataattactgttttctatgattgccttgttaatcacgctgttgggtatgatcatccggctgttgtgatatgtgcggatgaccgtatggcgcaccgtcatgtcctccacaatccccgatatccccagactgctgatattaaccttctcccccaggttaaagggcctggaccagctgagcatgatgccgctgatcacatcggccaatacctgctgggccgcaaaacccacgatggcgaccaggagggaagaactggtcagcagggttgcgctcagcgcctttgtggtggtaaacaggccgctgatacagatacatgccacaatggacaataagacctttgacatgcttcttaagaatttgatgtgaatctgttccttgcgtttcaggataatcccgaatattttgttaatagcaaacatgccggcgctccaaagtccgccaatgactgctatcttaatgagaagtatttccattcagacatcctttccttttatgactgccgcctatcagtctatcataaagaccgggaattgacaatcctggctttctttaagccggcatccatattcttccatccctcaccgtctcaatccaatttttcccattaatccccgtgctaaaccacaaagctttccaccccttttatcagaatggggaattacaaccatctgccctgtcttaacctcttccccgcagagcagtttatattcattcagccagccatcattccataaatggaacatctgtccgccaaatctgtcataaagcgcgctcctccgctgttccctggaagcataatacttaaaatgcagtccggccccatgctccagaaaagcggccagtcccctgtccgccgtatggcttatgagcatttcctctttggtaaaataggtgaacagctccattccccggatgtcagtgagaacccataccacatcattgccggatacattcggtaaaaaatgtccgctcagcatgaccgacataaatcctccccagtccagcgtcccgtccaacatgaaatcccggctgttgtcaaagcagtcatcccccatgcatacgctgtcgcgtgtcacatgaaccgataccatagataccataccagccatcacccccatacacatctaatcaatcccatcaccgatatccatacagtacacgccggtctccccggccgtgtccagccactccatacatgcttcatgccatcccctgaatgcttcctcatactgtccggcaagttcctggtagagtcccatctcaggccagtcccctcctgcccagaaggcctctgagtccagccagcgcccatataattcctgcatccgtatctgcgccgcttctgccttttcccctgccgcggcaagacgttccagggccaggttcattttccagtccgcataagctgactcagtagaaatttcccggagacggtggcgctctgcctttggcaccgcacgcataccggcaatcagggcctgctcctcggccttaatctgggccccgatggcggctccctcctcctgcttcttcttccgttccagataatgttcgtatccaaacggataatacatcacggcctggttttcaaatatcagcacggcatccgctatctgccgtatgaagtaccggtcatgggacacaaaaagtatggttcctttataagcacggaatgcggattccaggttctcctttgcccgtatatccatgtggttggtaggctcgtccaggaccaggaaattcgggcggctctgcagcagttcagccaggaccagccttgccttttccccgccggacagggaagacaccttcttctccgcctcccggcctccgaacagataggcgcccagaatgctcctggcgtccttctgcgtaagggagggaaatacacctgtaaaatgttcaaatacggttttccctgactgaagtcccgcgctgtgctggtcaaaatatccgatagtggtatggttccccagtgagaattccccatccacaggcggaaggaagcctgccacggtctttaagaacgttgtcttccctgccccgttggaaccaagaattgctattttctgccccttgcgtatgcgcattgttatttccagcagcgccttgtcataaccgaccttcagatgttcagaagtgaacacccacttgctccctgggacctccggtattatctctccagtgaagatatggctgtcatcctcctggggcctgtccacccgctccatacgctccatggccttgcgctttgcccgtgcaaaggatgccttattgggcttatgcttaaaacgctccaccaggccgcccagacgctccagttcctcctgctgccgctcataagcctttttctggatttgtatcttcttaagcttctcttccctgtaatgcgtgtaatttcccggataccttgtaagcctgccctccgacagttcatagaccacatccgtcgtgcggtccagaaaaaagcggtcgtgggaaaccatcacaaccgccctgccgtactgtcccatataaccctccagccattcacaggtctccgtgtccagatggttggtaggttcatccagcagaaggatatccggtttttcaagcaggaggcggattaaggcaatcttggtctgttcccctcctgaaaaccgggatatgggctttttcttgtcctcttttgcaaatccaaggccggtaaacagcctgtcatattcccgttcatactcaaaccgctcccgttcaaagctgtccctaaaggggcaggaccacaaaagcagttcctccacggtccggtgttcatccgcaaacgcctgctgggacagcattccggtcatcaccttcctggaacacaaaatccccggccccatccttttatcatcacggtccagagggattgcccctgcaatcacattcaataaggtggtcttacccgccccatttttcccaaccactgcaatcttctctgttccgtgtatctcaaaatcaatgtgggacaggatgacctttccccctgccgacacagttccgtcctttatctggtataacatatcgttatcctgctctttcttatacgccgtctgccggcatgatgctttcaataaaatgcatgaccttttcttcagactccggtctgtcaggataggaaaatgtcatatccataaccatatcatccacttttcttttaaattggatatgaccataaccccagccgtaaaacctggttgcgctgaatccatgtcctcctaccgtcagttccatctccacaaacggttccgggtaattgtaccggtgtatcaaatcataattgtgtttcctcatctgactggctgccggtatcccgggttcactatccttataataccagatgaacatggaaaagctgccctgctcatccgttgtaagcatattgaggtcataatgctccgggtccgcctccgtggcctccatgtatgccaccgtatccttcatatcactgcccggagggatgacaatgcggtaatccgaccattcattggaaaggacgctgccatttaaggatgccatgccaaatggcctgcctgtcccatcccgctggattgtccgggtctgcaggacgccatcctcaacccatgccccggaggaatccactgtatatccatcgggtgtaaccgtgttctggtacatgctgccctgtgcatcaaaacaatagcattcagccgtcccatccagattcccgtcaatccagtaccagttgtcctttaacaaatccccgtcatgatacctgtaactccagattcccagattatcctgctcccactgccctgccagggaaaccatccctgtcaaaggaagcatgatacatacaagcaatgacatgataacatttttaattgcattcctcaaaacaatacacctccctttaaggggaattataccataaatgattatatttccacatcatatttcatttacaaacttcttacaatctgttcatatttcatctataatctgctcatatttgatggatatactagaaaacataaagaacattgctttatatgacattgcttataagactttttttcataatacagccggagggagtaatccctgccggctcctccctttttatggaggctttcaagtacatggtatccgctaacctgccggactgcctttccgccggacttctgttccgccagactgcttttccaccagactgcttttccgccagaccgcttttccgccagaccgctaagcctcatcaaaacagatattgcctttcatacattgtcgtggtaaaattatcccatcacaccagttccgggaggagtgcggttctgcccgtatcgcaggtgtccggtctcacactgaaaatcccgggaacacgctgcggctggtgtgatttttgtctgcgcagcctgctcaaaaagtgtctttaatatgtttttctatgaacccatccaaatccctgacaggaatccccaaagcctcagatagttgaccatacagcagttccctggccctgcccgctgattccatttccgcttcatccggatatcgccttgccgccctgtcgttctgccggatgtagttggtttttatcactttaatccattctaccgggtcattggatgccaaggcaccctgatacagttccagacgcagtttgtcatttgccaccatgattgtccttatatacggcatcctctccactaattccaatgcttcttccctggtcatatcctacctccattatccattgcttcaactgacagatacaaaaaacgggcagcctgacaactggacttacgctgtcaggctactcgctgtgtttatattatagtggagatttctggatttttccagtcttttctcaattcagccatgcattccatggtgctttacagcaggatctgaaaattttcatataatggacaagttatggtccattgataactccaagcacttccattcctcattcatcacacggtatgtttccacatgattggaaatcatatcctggaagcctaccgctttgtaacaatgataggctgacggattattctcgaagacccccaacgaaacccttctggcgccatatatctgaaatgcaaactttaatccctgccgtatcattgcctttccgtatcccttgccgcgcttttgcgggtctacaatcacaaacccaaaccgcagttcatttactgatttacctggattccgcaaagtaaaaaagccgactataccagactcatcaaatgctgtaaagggtatcaatgatttaacaaaatcaaattccttcctcgtaataggataagttccaagcaccccggctgtccatttataaaaatcctcttcattattgcaccaggataggattatatcagcgtcttcatctttataaggtcttaatcgaaccatctgcactcctcccaattccgcttctttataaccactttccttgacactgcaaaaacttctctttctctttgcattttttctttcttaacctgtcatgtacagacagtttatccctatgccaatcataaagcggtataaaacaagccaatcacacaagcctctcctgtctcagccctaattaagcaaagtataacaaatacgtcattaaaagtgaagcatttcattttctgcaggctggaagccaaggtaaatgccatggtttgacattttccacatctttgtcatcccgcttgtccatatcagcagagaccatgggcagcctgattatccatactcccccaccctgtaacagaaggataaaaagaacatagaaagatagaacgaaaatgcggatggcaacatggacggtttttccgcattatggtaaaatagaaacaggatgcccatggaagaaccggaaggcttaccgtggcaagatagatgaattagataaaatggcgcagatcagagacatccatctgttccgtccatcttatccaaaagcaattgcagatagttggaaccattcaaatccattggcaatctgattgctggaattatccgggctatatcggaacctgtaatcgtatcaaggcatcttatagcttatacggatattgatcaggacataaaatcaatatttacgtataaccatattctttatcttaaaggaggaattcatatatgcaggatttttttgaagccctgaggagtgaaggaaaaaatacagcgctgcccgaagagtttgattattttggaaaactgattggcagttggcagattgactatgttgagagtaacagttcccgcacaatcagaggcgaatggcatttttcatgggttcttgaaggaatggccatacaggacgtcatcatcctgcctgattatgaatacggaacatcactgcggatcttcaatcctgatacacaggcatgggatgtcgcttatggttatacggggaagataatacggcttgaagcaagaaaacagggagaaatgatagtccttacatatatcagtgaccaaaatagaaagtgggtttttgtcaagattgatgaggataaattccattggcagaatgttactgtcaaagatgatggcgaatggcatataaatgcagatatatacgccgaacgtatcaaataagcatgtctgaacgtgcagggtaatcctcatgcggccaacaatattaccatcccactcatttttactttctgttatatcatttccgtaaaaataaaaggcccttcctccccttaaccatatgccggatatcatatatggaatcctcatggctgattcccatatcctccacaatggcaaaggggcaggtatgcgggcatccgcctccagctaattttgtaaggctggctgacccgtcattgccttccaggcctgtctgtatggccttgacaggtaaaaactgccatatacacctggaaagtcccagaagctccccaatcttatcttctttaaatccagctgattccccttcttccaacacatctgattccggtatgatgatttcataggtaaacgccccatcctccgggtaattgttcatccaaaagccccgcacctcagaataaccgccgaacccatatatcacctgtttataatcatgtgaatgatgttccgtgaacccaaggttaaaatcgccttccagcttcctttggttccattcaatgttttcctccagggtatcattttcaaaaccccagtaacctgattggaaggccatgccgtccttacagtatccgtcgctgcaattttatccatgctgctggctgtgatgagaaaccgggctgcggtgtaaagaaagcttgatttcgcggtggacggtttactggcggaaacgcgttcttctccccattgggatggcggacagggggaatgggtgttttatgacaccgtctatcaggtgtataatgacattctgctccatacttaatcccatctattcttttagttttttccgtataaagagcgccgttaaaaggtctaacccaataactacagagaaaatcaggccgaaaattgtctccgataatcctagtttctgtgttttcctcaaatgaaggattaacggtattgcataaaatgcacctgatagatttagggcgggcagggaaagtaagattgaaagaaatatatgctcattcctgcttggccccaataaaaagaatattcccagaatcatcccccagaataatgcaggataaagcagaatggacatgaaacggattctgtaaaatgcggattgtaaatccgcaattctttttttgagggacagggagacagcattcccaagatttacaagcactgccatcacaagcatactataaagcaggaaaggtatgtcctcaagaatcagatccatcaaatcatcatataaagctatctggaaaaatgcctcaatccaagcaaaaggcaacattatcagggtaaaaggcgggataaagagaaccaaaaaaagcattggacagatgatgaccaaatcaggaaataacaggttccatttttctgtgttagtattcatcatcatttccctcttcacacatgcaggacacctctccgtatttaaatatggcttttatggaatcctcatcttatatactgtagtcaaaatagtttagaaaaatccattcaaacaaagtataacaaagaagggtttaaaagtgaagcattacctttgccatatatgcagcttatccttcctcccctctcccactgacaaatctcctttcctgcagaaggtaaaaagcgcgggcggcatagacggatttaccgtattatggtaaaatatttatgatagaaacagcttcgtgacaaagtatctggccctttggggctatcttcttaaacttgaataagtggatcagttgattcagatatgcgaaaggaggcccccttggatacacataatacattggaacaaagaaaatgtctataccggttaagggggattcatgctatatcagctcatattgacagacctggaattatcttatgacaatttctcagaagattttcatatcggtttattcgaaactgaaagacaggctgaggatacggccctgtattatcttaaaaacataaaaggcttttgcgattttccctgtacataccgcattgtaaaaaaggaggtggttggcggcttcaacaatcgtaaccctgattttatatggatggtgcaaggatggaacctgaatgaaaatctcgatgaaatagatataatagaaagtccatgttttctgacagaagagcaggctggttctgaactccaggttttaaagggaaaatatcaacgggcggaatggtctttagacaaatacagaataggcgcattggaatggtgtgacggatttgtcaggatggctggtggtgtgcccgccaattaggttttagtttatagggatattaaaggatatgccctggggatgccatgccaccagagaacatcctaaagacgattggattatcaggaaacggtaattccctgtttacggaaatattggacagggagcagcatagacattttaactcagaaggaggatctgaatatgactacatacaatgtaaagactatgattcaatgtgatattcataaagtctgggaaaccatatcggcagtagggcgttatcatgaatggcggagtgatgtaagcaaaacagaattgacagatgggaaacagtttatagaatatacccaaaatggctattcaactatgtttacaattaccaaggctgaaccgcccagacgttgggagcttgatgtggaaaacagccatgcaaagggacactggagtatcgaatttacgtccaaaggcagtgaaacacaaatcgactttacagcgtccgtggaagcgaaacagctttctacgagaccggttggtaaaagtgtatttgaacaaacgtatttgaaaaaggcgcagacacaatttgtaacggatttaaagaaggctcttgcttaacaacttccaggagccatattgatttgccataaaaggaaatttgattccagcttaatttacaagtattgaatcgagcgtgacatcgggatttcaaggaggataacaacatgagcattactgtaaacatatattatacaggtgtaaatggaaatgcgcataaatttgctgaagaaatgcggacaagcggaaccgtttctaaaatccgcagggaagatggaaacctacgatatgaatatttcttccccatggatgacgcagagacagtgttgttaattgattcctgggaaaaccaacaggcactcgacaggcaccacgcctctcccatgatggaaacaatcaccggacttagaatgaaatacgatttgcatatgaaggttgaacgatatttatcagacacggacaagatacccgaaacagacaggaaattcataaaagaatagcaccaacacgccctacggcggaattaacagtaaaaaaacagtcctgtttaattgaatatgtatggaatcgtcggaaaaagtaatttagtattctgcattgggataatccgcatagtctgtcccggcacgaccagctgccatgagcagctgccacggccggctgccacagtcaggaccatcacattgtcacggggatggaatttatgaatcacggtgccaacctgctttaccttgttgatggtctcttcttctgcttgttttgctacaataacatcctgatgattcatcatgatagggtaaccggaattgtaagtgctccttatcccaatggagtattcattagatagcgtttaacaccttatttatttgataaacttatttaacctataccttatttacaaaatccaaattatattgcacagcaccgtggtttctaaatatcgttgcacttgtaatacggattgccaaaataacgcagttttcatcctgttcattatttgcatcgtcataccagtctgcaaatacttcacgaagttttgttcttagcgcagcgtttttgggttctaaaacccagcccaggttttctccaatgccatgtccgtatatcccctcaaagttaactgaaaatgcaacttctttattttgggttatctgctgtattttatttgattttgctgacgttgtaacataaaacacaccatcttcataataagcgcttacatcacggacactaggacgaggaaaaccatcagcacccggttccgtagcaatagttgagagcgcgatgacattatctttcttgttgccacaactttcttcgattaatttcattccttcttcatacctgttcattgtccattcctccatcaattccgattttgcagactgataaataaaattaatgcctattactgcctatccaatagcatccggctgccaatacagaagccaataactccgttgcacgggcattgatatcataacccccggaacccataagatagggcgaaccccagaatacaatagcaaaaagcatgagtgcaataacaatccgcttaatttcttccttcgtcgcaaaacacctccattcaattccaattaaacaaagtatagcaaagaagcctttgaaagtgaagtaaaaccctccaggtaagcgaaaagtctggtatcagccgtggctttttgtatcttctaatcttgactatgatttccagcgtttatatacttatccatatatgaaaaaatggaggggttaaatgtatcgcaaaagaaaagaattgaccagcttttagacgaatacaatcaggagcaggaatgggggtcctgccttgattgtggcgatgatgcattctgcgtgtacgatgaatatgacaaaggctattcatttagctgtcacaatgaagactgtccgcaccattggccccaaaaaaattgcaaagaacaaagaggatgtacctgattggtttgcatggccattaccataaatatagtataagacagaatgccccggcatcagccagggcttccatgaaaatcagaatgtaataatcttcgcctcgccgctcacggcagatgcctttgccgcccgttccaggctttcattggcgctggcggcggtttcctggacgaaatatccgcattatggtagaatgaaattaatataagaatcggaatttgacaaggagaacgtatatgagagagattttaaattatccacctattgagaagacggaacttgaaacagttaaggctttgataaataggattgcagaagcaacatctgatgaaaattgcagcagggaattaagtgaattaaaccgtattactggaaagctgcatgaagcgatagagtttgcagagtattggggatggacagacttagatacattagcagaaaaagtcctgacagcagagccaccctatatcaatgacttaacgaaagatgaaattgctgaaattgtatcaatgacaaaaacatgcttattgtcaggagaggacaataaggcagactattatatggaactgcttcataaatctttgccattaacagatgtaatgcgttatatcatgtcagaaaaggatgaggaaacaatagtaaatgacatgattaaagccgcttcaaattcagtcattgctttataaatggaggaaaaatgattttatacaggcctgtaggcacaaaagaattggaattaataaagaaaagcaattatcgtagctttccacccagattaccggaacagcctattttttatcctgtcctgaatgaacagtacgcaacagagattgcttccggctggaatgtgaaatataatgatgaccataaaggttacgtcacaaagtttgaagttgacgatagttattgtggacagtttgaggtccatcaggttgggggcgcacatcataaggaactatgggtcccggcagaaaagttagaggaatttaatgaacatattgttggagaaatacaaatcatcagcgaattttcagagtgagggatttttttggatacacatgatgccttggaacaaatccaattgctggatacggaaagccaggacaggcgcaagctcctgctgggaaaaccggataaacaacaggctgctctcctaccaaccaaagggcagcctgttgtttttcttcataccctgccctgcggcaggtaaaaagtatggatgacaacatggactgattttccgtattatggtagaatatttgacataatgattggtttggctatttagacaaggcgcaaaaactggaattgaaagatgattttgaaatcatgttacagttttctaatggagtattatcaaaacaacgtattgagctgttaaaacatgtattacaatattatgaaaattacacatccatagcaattaaaccattgaaatcattcaatattgatatgggagatgattacttttcctattgtgtttatattggagaatatagttttggaactcacgtctttcatatatttgatggcttcacagttagcttaaaaagggaaatgggggaagccgatgattatcttaatatgagagtgtatacggttcagttcaaaaatgatggtcggccgctaggtattgatttgtggtttgaatgataatttattggacggttaaacagaacataaaatcggaattgattgagtaaaataaagattgatggtgtagattatgaaagagattattaagaatagagttgaagaattactggaaaaggaatattattgtagttcaaaagaactgaacgctgacgatattgtttattccattaacacaacagcgactaaaccgtatataaaaataatggcatataggaatagtgtggttatatgtacatcaaaagatatatctgcaaaaatacaatcacttttatttaacaaaaacagggatgaaatttttgaattaccatttgtttatggtcagacaatccattatgtgccagataacgattataaggatattaaagccacatttttaggctacgaatttcaatttcttttcgataaggacattttaacacttaaaggattaaagggatttgaaaattctttagcatttaatgataatggttttacgccaacaagagccatttgcattgcaagaaatcgaaaacagattgtcggaatttcaggtgcagctttgtcatcagtagatggtctatgggaaataggggtagatgtttttccagtatacagaaactcaggaattgcgacatacttagtaaagagattgacgcaagaattgttgacacaaaatatagttccattttattcggcctctgttacaaacattggttctcagatggtggcaagcagatgcggctatattcctacatggattgatacatttggaactgtttttgatggaagctgcgcgtatagcgatattacaaatgctttagttaggggattttaatataacaaataccagtttaaataatttacacaattccaacctttctttaatataaatagcaattaaataatgcttggaggaattaacaatggatgaaatattaaaacaattaacaatcgagtatttagaggctgttgaaaataggtgtagtcttctttttcaagcattaaacgtaaagaataagtttgaattaggtcctattatgaggcagtgtcaagaaccgcgaaaagagttttttgtgaacggaaaacggtatgaagcttatttgcatggtagagggtgtaatgtatttgatggacaaataaatattgattgggattttgatgctgtgggttatggtatcaacccacatatgctatcgtattatattgagcaaagtgcacctgagttaaatgagttatatcctgaagaaagaataaaaaatgagtttgaaaaggcattagccactggagaattagtcaagagatgttttctttattattttgcataaatttatgacaaagttcaggtagctcctgagcttttcagactgtagacaaagcggctctaggatttgtatcccagagccatttttctattattatccgaattgtgtataaaacagcaatttcgcttaaaatgccagccaatgccacaaacaacgcctatcatatcgggatgattactgggagaaacctgttccccataaatatgtttgggcggctctggtaattcccggatatgtttaatgtccggactgcaggcagttttaggcaacgtaattaccactttaccgttttcatctgtttcgtattggataaccttttgaaataatccatcttgtatgacttcactgtcaaggcatatcccccacatacaggcttcctcctgaatacttttcctctgtaaaaatccaactaaacaaagtatagcaaagaagcctttgaaaatgaagtaaaattctccagttaagcagaaagccccagcatcagtcaaggcttccatgaaaatcagaatgtaataatatttgcctcgccgctcgcggcccacgcctttgccgtccagattatccagcatgaggatgaggaacatctggtggacctggtggaagccatctgcgagggtgactgggattccgtggggaacatgctcatggacagctactttgacaaaatcgaagcccagctctcccctattgaacatgtggcggattatctgaacgacaggttcgactctgaatggcaggcggattccgaggccatcaagaagtccatctgtgaacgcctggaggggatatccaatgtttcctttatagaccgtgtctgcgacatcgcggaaaccctgagcaacatcttccatgggtttgacgtcacccttgcccaaatcggtaaatcctatgctggccaggatgttgaccgctttgaggcggaaccccagaacattgaggttcctgaagcagacactgcggttgaccggcatatcagcgatgcggcgccggacatcccaaccagcctggatatggaaacggatgattttgatatggacatggagctttcctcccaggttgagagcccacgggacttcttcgcagacgtggaaggcatcacagccggggctgaatccgccaccacggccgaggagctggaagcctcctggggtcatcaaacgccgttcgcgcaaagagtccaaacctaagcgccccaggaaaaccggcaggaagctgcacagcaaaatccataggcaggaaggagaatccttttccgagttccgctgccatgagacctctcaggaccatacggatacggctgtaaaggctatgggcagccaggacaactcctacagctatatagccaaccatacacaaacataaagctacaggctgctctcctatcgaccagagggcagcctatagttatttacatcgccactgtcaaagtctttgtgtcctgtgatgggatgacatggacgaaatatctgtattatggtaaaatgatattgctataagaaccggtttctgatggttcaaaacgaaatcgacatcattatgttggatacacaccagcacgaatcggaagttgatggagggaaaacaatgtttacaaatgaaatactgtctacctgcgaaaaagcttgcgcagacgatttgtcagaacttgaagaggtatacggtttcaaattccctaatgaaatgaaattgttttatcttcaatataatggcggtaatctgaagcgaagggaagtttgcctgcaaaaggaggattggaaaagcagcacaagtttccataaattctatacggtaaagggcgaatttgaaaacatattaaaagaagtctattttgaagattggtggataaaatggttgattccatttggacacgatgatggcggagaacacttctgctttagcaccagggattgtgattatggcagtatctactattttgtaagcgagtgtattgatgatgaaaacccagagaatgcattagtaaaagtgggcggtaatcttatcgaatttattaacaatatgaaatagaaaatataagcaatcggaatttgacggaggcttcattgtgttagaaacttttgataaaatgggttatgaagaatgggacaaacaaggatttgtaacacctaaagacattttacttgatgagaataacaaattgcacgaagcgatagatgtattttacattgccggagggtacgacttctttaaggttataaatccggcaaaatatgcttcaaactggttggactttgttggaaacctatattctgaaattgtagatggaaaatacaaaccagatggtaaatatcataaaaatccactaacagaaaaacagagaaattcacttatcgaacaaggcgtgccggaaatatttacaactgatatagaataaattccggtttgtatcggtgggttaaacagagcgaagaaatcaggatttgtttaatagaaaatggagtgattatatgaaagagggcttttattgttatagaaacaatatatactacggttcttacgatgagaagcaagtttcaggacggatgcgtatttcaatgatttcaacgaacaaatctgaacggattcggacaaatcatccgatatccgaagatgactgggccgtccggttatgggacaatcacagcctgcttgaaccggagtatgcggatttgcaggaaatgttcttgaaaatgagggcgttcatgaacctcagcacagaccaggaggttgatttttctgctgtggagaatcggcttgatatttcttttcccagggaactaaagcaagtctatcaggccattcagaaccaggaggagtattttacaggcacggaacatttcctgcccctggatgaaatatatgtggagcagggaatcatcgtcttcttcaaaaagaaacggacgcccattgcaggttatgatatagagaatggatgccttgcagagtactacaaaaaagattggcatatagaaaggggcggaatctgctgttatcagttctgtgcgggcagaatgcttacaatcgccattgagaataagcccgttttcaaaaagggacgatgtaagggtaaatttgtgacaacactcaacattaaacaggaattagaaaatttctgcaatgagaattatcaccttttgtcagagttccatgtgtatgggattgccgtgatgtattcagacaatgggctcatcgcctggattcggagcaatggattttatgcggatatccatgcaggggcaatggatgaggcccagctggaagcacttgctgaacatctgggcgctatggagtggaaataaaaatgattgtgtcggttccgccatcatggtgtctgaggaatgagcccacaggcataaggaatatataacaaaagtctgcctggatttgattaatgacaaaggatacaaattatgttgaggatatcggttacatttttaacagcttgaattgcatgagaacccggaattgaaaggatagacagtatgattacaacaaaaaaatttccactaaaccgtttcaatttttcaaatctcattgaacagattagaacagacgtgttgataccaaatataattactgatagtgaaacaggaatagaattttatggtgcggataccatttcaaaaaaagcactgatagatttgcttgaaaattttaatatgattgataaccttgctcaacaagacaacagacatgaatatgaaaagcacacacaacttgatattaaaaattttcaatttgaaccgtcatgggtagagattactcctaacaatattaccgttggatatgttggcatttatatcaactctgatttcagtttaaccttttcaaaaatcaacgatggatgggttttgataaaataacaatgcaacagagattgcttgaagcgcagggatgtgcggaagcagtttttggaattcatcctgaaaagggggctgaattacactggaaaatgccatccacgcctgtgaaacgctgccgtagggaaggccccggcgcattgaggtctcggcggtgtcttcccctatgttctgtgccgagtttgccaacacctgtgacgggactgtggtatttgacagcgacggcctccccacctcctccgagccggagcacgacgtgggcacccgcagcatgaccgtctttttcacaaagcacacggcggtataccagtacagcgtgacggaagacgggatgttccagctccggtttcttattaaccgctcccatgaacaggatggaggggcgtctggcgtgaagacataaaagttcaatagggatttgtgggaggaagtttaagttgacaaaatcatacatagttattcaaattataggcttcattggagccatattgttctttgtatcgttccagtgccgaaacaataaaacattattccgatttcaatttctatcttacttgttatatacaattcatttacttcttttaggagctataactgggggagtaagttatattataaacgccattcgttcattttgcttaagcagcaggtgggactttggcagaagccaaaaaatgtgcataattctctgctttatgcaggttgctgccttgatatttacctgggtcggatggattagtatattacctgttgcagcaaatatagcagttaccattggagcatatacttataatgcgagaacaatacggttggtgaccatgctaattaattcacccctttggattatttataatattattgttggaacgtgggcgggaataattgatgaagcggtaagcgaaatttccatcggaatttctattgccaggtatggctggaaaaatctcggaagtgaacaggaataaattcccatttatcgggctgataaatcgggaatcatgggtcccagataaaacaacaggctgctcttccaccaaccagagggcagcctgttgtttttcttcatccccgctctgcggcaggtaaaagtgtgaatggtaacatagacggatttaccgtattatggtagaatatttgttatagaaacagcttcgcaacaaagtatctagcactttggagcagacttgaataaatggaatagaagtcggtattttttgaggtatatgccatggaactgataaaagaagaaaaaccagctgagcaggaatggcaatggtgtcttgtcggcaatatcgttggggagcatatatctggggaaagccacgaattaaagtatgggaataaacagttccgtccacatgcgaaggtatatataaatctaatctatgctggaatgggccatgaaagcatacttgtcttgggtattcccagacattcctccagatacatagaaattgtaatcgcaagaaagtatgtagagaacttccgtctgcaaaaagttttcaaaccagtcgtattaaaacaaatgcaccagtcgaaatggaattggtggggaaataccgattcagcccgagaccgcttgattcagtttcttgaatggataaatccaggcgaagcagaaaaagcaaaaagtaagtatataaaacctggcttaccagaatgctgaaccggacctcggccttatagctggatggctggttaaatgtttccaacggttatgcagaactgtttgataagattagcttaactttatgggggtaaaacagtatgctgccacagaacacaaaagaatctgtaaaagagagacgcatcttccgatataccctggctgatgcatgggaatatacaatatcacaagtggatgtgttggaaggtgtggaaaaaggaaatgttcgatgcctatattttaatacgcccgggatgcatgctgacacaaacgttgattcccttatcattacgattagccaaaactatatagacatgattaagaacgccatgctctcccacttggatgtctgcagatacaaggaaattgaatttccgatggtgctggacgggttcatcaatacgtttgaatttgcgcccaaggaatccttttccaacataattactgttttcaacattttcgcattcagggatgcggctaatgtgggcatagtgggtaatccgccatataaagggaaagaggttctgaaattgtatgatgatatttctaaaatactgtcggataatggagtggaccaaaaatatctgtcgttggattaccaactgccgcgacgaccagaggagagattgaagaaatagaatatggaaaaaatctgataaatttaaaaactcattccttacttcgtataagcattgactggcaggataggtgcaaccccctgctggaaagccggataaaacaacaggctgctctcctatcaaccagagggcagcctgtattttttcttcatcccctgccctgtggcagataaaaagtgtggataatgacatggacggcttttccgtattataattgtaagataattttaactttcttcgtaccatatttctccatcttatatcttataataaagtatactaaccgcatgttttgatgttactataattaatgcaaaacaggggggcttttgatgaaaatcaaatactttatagcaggtgtggccgtatatttcttttttagtttgcttaaggctatattatagccacaaatcaaacatgctaaggtacatttccgtaatcaaatgcactatcaaaaacgttaaacataagcgcctatgaaaatgaaacgctggtgggctgcctgcggattctttcagatgactatttctttggaactattacagaactgcttgttcttcctgaatatcagaaacagggaatcggcagcaaactcctccaacttgccaaagacaatacaccgaccttgctatattttgtcgcacaaccagatgcggaacaattttacgaaaaaaatggatgccacaagagcctacaatcctaccaaatagaaaaatagcgatagttatttagttttctgtttactgtgaagttacccgaaggacaaattgggcattgaggagggaaagatgaaaagaaaatcttttatctatacaatcataagcatattcgtaatgattagtttgggaatacttttgagtctttttgttataggagaatcgattgatggaaaacaactatactgcactacttccctgaacggacaaactttaaacttacgagtagagcctgtagagtcaggcgttgcgcttcgaggctggaaattcaggaaagataataatattttatatatcagcgcaagaaaagtattggtatccccactctttcatgaaggaacttacgaaacatcgattgatttagagccgattgaaagtgttatggttggtggtcaaacaatttggtcatatgcagattaaaccgtagaaggatggaaaaatatgaatggattcccaatgactataccggacgtgattaggaatagcctgatgaaatagtttgacaacgtgggtacaaaacctacatcatagaaaaaaggagagttttatgaagcgatttatgctacttgcacttatgaaagcacttgtccttacaatagggaccggttttttatatgttctatatggtttaatatttgaaaaccattttgaaataaacttaaaaattgaaataatacttttcctggtaatattctttgttagtttaattgaatatgcatggaaaaaccgaaagaagtaacgttatgccacaacgttaggaagtgaattcatgatagacaaaaagattgcaggtcaatttactgtagtaacattcgtccttgcttatgcaacagcaggtatactgtttttctttggacagtttggttatagagtctataactttacaaacacatttaagcagtttgcagcgaatattccttttgccatctacattctgtcgccagcgattgcttcttactttgttctgaagaaaaataaaagaatcacttgccttatagaatggctgaaaaatgtattttatgtgaaaagcaactgctttccctatttatttattgtattagggttagtgatgtattttggcatacaccttgttgtttcgggccatgcattaacagagtttccattttatatatttttactttctttgccgggcaatcttattatcggcggtttagaagaatcgggctggatgtatgtattacaaccactgcttgataaaaagtacggatatattctgtcatctgtttttaccggggtcatttggattttttggcatattcctcttttctttatccctgggacaaatcatgaatatgggctaattaatttggggatgtttgctgttcagtgtatagctttgcgatttttctttggagcagtctacaaagtatcagggaaaagctacatatttatgtgtgtgctgtttcacacaatgtttaatgcagcatccactatctttggaacgataacgatgaactggacaggtacgattgttgcaaatgccgcgattatttttgtttctattacaaccattaagatattatcggacggttaaacagagcaaaaatcggaatttgaaaggagtaccactatgaaaaagaaactcaaaatatctttgggaataatattagttcttgcattagcaatagtatcttataagctcatcgctagtaatagtatcaaagacaaaacctattcacatttagaaactattggatatactcaaaatgatattgacaatgtagagataaaacattcctttctcaataaattattaggatataacgaatggcgaatttttgttgagtttgaaagcgaacctgatattatttttgcttttacatatcgagataagcaaattataagacagggtataacaagcaaagttactcaattagacatagctgaaattgaagaatatgacagtaagtttgataatggggaattaaagaacaattagtaacttcatgtttatcggggagctaagtagaacgcaaaatcgatatttacggagggaggccatctaccggacttgttccttatgataaagcggtagctgaatatcagtttgtaaccggattgggggacttatacagacagcgcccttgcttacaagagataaaatgagaagggggatatgttgtgagtaaaataatctgtatgtttgtttgtatctctttgttgcttaatctaagctttacatcatatgcatcgaaacgcttgataccttcagagggaaacgagtatcaggagattctttctatgaaggatgatgttttatatcatatcaattatggaggagcacgtacagaactcaaccgggatgtggaagcggatgaggtgaaaatggaaggcgcatataaagtttatgccaattctgagctgttagaaacaaaagatattaagaaatcattggaaaccagttattataaatggcaaattcccgtatacatagacggttttacgattttggttgatataaccaaggtaacatccattcctgatgatattccggaagatgcaaaagaaacgctcagacagaaattaaatatttggactgtgggagctgtctatgtatacgatgcagaaacgattgattatgacagtactgtagcaacttctcttgacaaggcggggtacaacagtgatgaatattcatacgaagttgtttcaggacttcccggaatcagatatcctgtagccatcatatttaatgctgatgaaaaacctgaattcgtgattcctgcgcagaagtctactacacatgcatttattggggaatggcccacagcagcaaaaaacagggaaaagacaactgcatcttcaaatacgcagaatattaataatgataacacaaacggtttctccgtttattattatgatgatgttgtaaggacatcaaattcctacaatcagtcaggaataggactttcttacaaaaaggatatctttaaaaaaaatgccatagcagtgttgatattcggagctgccggaatcttaatgattataggaaaaaaaaagaaataagaagagtggtatatgaactggaaaaatgagctattaccattttaagtgccatactaacattgtctatcgtgaggtggtatctgaaagagagataaatctgtaaaattatgatttataaaggcagtcatattccctgtaactttgtagttgacgtatatgctgactaatatgaaacagccgatttcaccgtaggcgtttggctgcgctacgagtgataggaccagcaaaaatcaacttccggtttgtcggactgttgaatggcctatcatcgtttcatagcgctgcgtcttcccatcgggtccctccctgcgcttggtctggatggaagccgcgatgcagacgcaatcattttcggcaagcttcgctgcctcctggccgaccagcccaaagcaggtcagccttgggaaattcaccctgccgttatcaaccgtcctgagagtcacgatggtcccaatcggggaacagccgttggaagggatttcatatatgccgattacctttccaaggatgcacacctcattgcagccttccagcttacgggctccgatattcttttttcctgtcaggtactcaaggtttgtgggcgccctgctcaacgtatggccaacaatgttctgataatactgtgtctggccgttcatagtgcggcgcgtggtctggaccatcccttcgatgcacaccctgggatagttccccggggctacttcaatcgttttgtcaataatttcagctacttccccgtaaaacaccacattggggtaatctgcatggtctgttccggcacgtcctgctgccacggttaagaccatcccattgtcacggggacggaatttatggaccacgctgccaaccagctttaccttgttgatggtctcttcttctgcttgttttgctacgataacatcctgatgattcatcatgatagggtcctccttcatttaattgggggtgtttcgatataacagtatgtcagaaccctattgagaattgaaaaagccccggattacaccggagctatgatatagacaatatactttccttttatttttcctcgtaatcagatgttgaataatcaaggagcacttttttacatgacttacaaatatatgcctcaaaggaaaggccctcaaaatcgttattttccaataatacttcacatttttttgtaagcaatgatattttgtgtggagtttttatccaaaccattcgttgaccactttgtaaaaaacccggttccatctcttctccacatacgggacaccgcatattgcacctcctccctacaaacatgaagttgtctaatacttattgtatgtgtatacatcaacagttacaatttcttgacctccccaatttttttcttgcacagtaaaatcctcttttacaaagccattgtttaatagcacttttgatgaatataaattttctggcataacaaatgcatgaagtgttgtaatattaacttcatttactaaatattcaaccatcaatttcaaaacatttgttgcaattttcttattccaataatcctcatttagacgataacccactgttattttattttctctctttttatagtcaaacatttctgctaaacctacaagcctattaggattatcttttaaataaactcctgcaattatatactttttcttttcaaaatctcttccaccaagatttttgattgcattctctaatgctttgttacttttcttatataagaatggcgatatatacttataaacattctcgttcttgcttatctcggacaaggctacaacgtcatttaattccattttttttataataattttttcgttttctaaatatggaaatacaccaaataattctgtcatcataacctccataaattctaattcagagtcttatttgctccataataagatttgtattttctccgatggactttgttccatccactcgtataacaggacagcttaaagattgcagccattcctcaacatcattttcagctctggattgaacacgatgaaagaagtttttttcctgctcatataaatctccacccggcagcattctattaccgaatttctgaaaagaacggtttttaacgcgttgtatccgaacatctctcggaacatcaatcaaaacggcatactgaaaacagggatagagccattctccgtaatccccttttacggaagcaaaaacaaaattttcatacattttaatttcattgaaaaggagttttgccgcttcttcatgggtgcgcggataagcataactataaagagggtccgccgtaagaaaatacagactctcgctgtcaataaaatgaaaatttaatctctctgccaaaacttttcccaacgtactctttccagtcccgtttagaccacatacaattattcctgttcccacaaatttctcccccctaaacagcggtctgccgcgctgttcagttctccgacaaattctaatttttcagtttgacaaacatgaattatagagtttctggcctatgtttcacttgtacttccaatttcaagcaaattcccctctgggtcagctacataaaaattgcggataccgaaaggataagtgatgggttctcccgtgggaaactgcacacccaactttgacagacgctcatactccaaatctacctcagcaaaattggatagccaaagggcgatttcaaatgtctgattgataccctttggaagtacatagtcttctcctattgcctttacaaattctttcctgctatacataaataaggatagttctccacttgcagtttcaaaatccgcaaaaggtccaccattccattgagtttgaaaacctagtgtatctctataaaatcgaaccatattttccatatcactgaccagcaaactcacaccgatacgtacatcttttccattcattatcaatacctcctctacaacttccgatttcatagactgataaataaaattaatgcctattactgcctatccaataacatccggctgccaatacagaagccaataactccgttgcacgggcattgatatcataaaccctggagcccataagatagggcgaaccccagaatacaaccgcaaaaatcatgagtgcaataacaatccgcttaatttcttccttcatcgcaagacacctccatccaattctaattaaacaaagtatagcaaagaagcttttgaaagtgaagcggaactctccaggtaagaggaaagtctggaatctgccatggctttttgtatctttaaatcttgactataatttccagcgtttatatacttatccatatacgaaaaaatggagggcttatatgtatcgcaaaaagaaaagaattgaccagcttttagacgaatacaatcaggaacaggaatgggggtcctgccttgattgtggcgatgatgcattctgcgagtacgatgaatatgacaaaggctattcatttagctgccataatgaagactgtccgcaccactggccaccacagattgtaaagaacaaagaggaggtacctgattggtttgcatggccgttaccataaatatagtaaaatgcggaaagccccggcatcagccagggctttcttgaaaatcagaatgtaataatcttcgcctctccgctcacggccgacgcctttgccgcccgttccaggctttcattggcgctggccaggaacacatggtcataatcctccaggtctctttctatgagtccaaacagcatctggcacgaggtatcatccaggccgtccaggttatccagcatgaggatgcggaactggttcagggcgttgaacatgctcatgagcacataggctgcacggagctgttctcctttgctcagggatttatagtttatcatccctccgctttccttatctgcaaagagaacccggaacccgtcgctggtatccagcaccatatcatacttgggaagcacatcctgcattttctcattgcagtaatcctgcagcggccggatgtggtattccaggaccttctgccggacgccccctttgggggacaactgttccaccagctcctgctggatggcggtactcttacgcagcttaacactgcgcttctccgcctcctgcgccctggcatatttcgttgcgtcattcagttcattcttcagttccatctccctggcctgaagttctgtcaaaagccccaggtccggtttcacaggcgctgtaaggctgaccttctgctctttctcgtactgctccaggtagacaagctttgactgatagtcccgctcctgctttgcaatcgcctcccttttcttttccagttcggccagttccttttccaggcgtgccttcttcatgcggccacaggcggcaatttcctccttctgctccacgccgtcctccagctccgagcggatgccggtcttatccgtggaacacaccagcttattgctgatagggcagacaggtttggccaatgcatccaggacctttcccatgaaggcaatgtccttctccgcaacctggatgctggactgtacttcctggagcacatcccgcttgttcttaatctctttcttcacggattcctgccctgtcttcggcggggccttgacttccttatacgcctccagcttttccgcaagggattccattgcctttgtgtatgcgtcataggcagccttcagttttgtataggaagcagattccgctgataaccggccgatttgctgggagacagattgcttctccgtgttgatgtcctccacagagcgggtcgggacagggccggcatatttggctgcagcctctgcctccacaagggacttcttgcgttccgccctcgccgcaaaacacatatcgtaggcttcctggatatccccaagggtaatcttctccggggcctccggcaggagcatccggagttcatcttccgcgtcctttgagagggaacacagggacaggagcttttctatatccatatcattttccagaaatccctcgttcagcaggtattccgccaggtccgcgcccatcatctgctccatgagctctgacgagaacatcatgttcattgtcctgcctgagcacccaaggatatcccccaggtcccttgcgacgtcctttgccgtcgtggccttgccgcacatcagggtctttgattttgaaggggtatacctccgctcaatggtgcccagcttttcaagctccacggcaacagagcttttggaagcccccatcgccatatagtcgtccggggttttgccggtgatggcgcagcgtatcccttccagcatgctcgtcttccccatcccattgggtccggacaggatgttgattcttgccggctttacctccagattttcaattcctttaaaattcataattttaatattactgattttcataaggtactcttctcctttcatcgttaagcactgcaaatgagtatgtcagattcccgcgcctggagaacttcgtacatactggacaaaaggaggtgctgatatggacgaatcaaccaatctaaacgaaattaaggctgaaccggaaagcgacgccattgtagatacacccgatgaggcagcaatagagcctacggctaacgaaggtgctgaacagaccacagctgatgataaccacgatgcggatatacccgaggaagataaggaacttttcacagagttcggggaggtcatcagtgaagccattgtagacgccctgaaggaggtttacggtgaggaaaccgccgatgaactttgtaccggcattgcccaggaagcacgggattctgagcagcccatccaggaaatcatcagtgagaaggtcgccgagcttgccggcatagatttggaggcgcgggtagacaccccctcaatggatatagagccccctgccgaaccggagataagccgctattagtccctgaaggaatgctatgattcggataaggacaaatatctgttccgcaataccttcgtggtcctggagcgcctggagctgaacatcgaggcctataagaccggcgaggatggcgacaaagggcggcctgtctccggcggcgacatcgccatgaacatcatagagctgacgcggagcaatgtgtgggaatccatggtggagattgcagtccgcacctatttcgacgaacatttcccggcaaaggtggataccgggaccaccgtggaggaaaaactggatatagaagctgaaccgcccaaggtggaccgccccgacctggtaagggacgcaagcggcactgtccgggatgacggccttgtctatgggcgcaacgtggacttaaaagaactcgggattgacagcaaaaaccccctggccggacactacatgggcgtggacatgaccaaggccccggacccgaagatgtccgatatcagcatggacgtctggaaaaccggccgtggcgtcacggataccgtgaccattgacagtgaggcaagcaccctgcgcatcccggatatccggctggtggaattcaacgatgaccactatctcgtagaccccttcggcaaggtggtagccagcgatgttgaccccacggaaaaagagcccacaaactacttcaggagccttgatatctccagcttccggtataatacgcccatggttgaggccgctgcccagggcaaaggcattactgtagaggaatacaaggaactggtttcggataaggtcaaggcggatttcacggaacgcaccctggcaggttttgacgcgcatgcggcatacctgaaggaccagatacctgatatcaaaggaaccattgaagcgtatacagaaaaaatcgaagccctccctgcaaaggaagaagaactgaaggccggcattgagcgcattgacagcctcccggccgaatccatgaccccaaaggatgtcagcacccgggaatcgtacgaaaagaacctggtggacattgtggaggcaaaggaaaaactggcctctgccgttgaaaaaatggacgcccgggccgaaaagctggaggctaccattgagggatactcacaggcgaaggccgtctgttcctcaggggccacggatgtggactcctccctggccgtcgtgctccgggcagacatggatgccggcggccggaccggcaacgaggattatggcctaagcgtagaggatattgagaaaatcagcagcgccctctcctccctggaagccggagccccggatgatgtagaggtcaaaccagaggacttggaagccaatccggacagccaggaggataacgtgggcacccaagaggataagcctctggatttagacaccggcgccgccgatatggaatcttccagggaaccagatgcccaaactgcccaggctgacacagacgcacaggtaattgctgataccgaaaaaatagatacacagacggaacctgatattgaggatgaagatatcggcatagaacttcccccgtccccctttgatgaggaaatcattgaggaagcacagggctatccctatgttgacatagatacttatcaagatgaggtcctggggccggatgaggattatatctctgctgatatggacgcctataagccgctcccctacgatggtcctacgcccgtgactgaggaagactggaaatccgcacagctggaacatattcaggaatccatctatggactccagacagagggctattaccagaaaatcaacatcaccaatgatatccagtaccttgggtatcaggaattcgacctgcagccggactggctctatgaaaaccttggggacgatgtggcggatgtcctggctgactataatgggatgaaggcaaccattgaatccattgaccagcgcatggagacgaccgacacttatttagcgctcctgagtaacccggatgtcagcgacgacgataagctggcagcctttgaccgtatggccgggaagatgggattcacagaggaaatgctggaaaccgtgtacatcagccggccggaagaaaccccggatgtggatatccagacagatgataatgtggatacacacgaacctgacgccatagctgcagacgacataccggatatggcaggaacagtaccggattcaccccctgatgaagatgacgccgtcattgtggcctctgaggaggaatctgtgggttatgaggaaatccgggaagccctggaccggttcattgaccaggggcctgatggcacgttctccctgaaggaagatttcctggacaaatatgcaggggaaatcccggaacaggacttcttctccgcctttgccgataaggtcaaggagattgaggatgaggcaaaggacgaggataaggatgtagacgccaatgccattgagcgcctggccgatgccttcagcgacattgaagacgccgccatcagcagcataacttaccaggcggaacatctggtggacctggtggaagccatctgtgagggagattgggatttcgtggggaacatgctcatggacagctactttgacaaaatcaaatcccagctctcccccattgagcatgtagcagattacctgaatgacaggtttgaccctgaatggcaggcagattccgaggccatcaaagagtctatctgtgaacgcctggaggggatatccaatgattcctttgtggaccgtatctgcgacatcgcggaaaccctgagcgacatcttccatgggtttgacgtcacccttgcccaaatcggcgaatcctacgctggccaggatgttgaccgctttgagacggaaccccaggacattgagattcctgaagcagacaatgcggttgaccagcatatcagcgatgcggcgccggatatccaaaccagcctggatatggaaactgacgactttgatatggacatggaactttcctcccaggtcgagagcctgagggacttcttcgctgacgtggaaggcatcacagccggggcagaatccgccaccacggccgaggagctggaagctgctattgccgccgtataggaaggaggacaacatggtcacaggatataccgtcacactcttcactctgctcctgctgggctgcctcatcgggattgctgctggtttccacatggcgtacacggtgccgatacggatggcccggcggaccggaagcctcctggggtcatcaaacgccgctcgcgtaaagagctcaaacctaagcgccccaggaaaaccggcaggaagctgcacagcaaaatccacaggcaggaaggagaatccttttccgagttccgctgccatgagacctcccaggaccatgaggaaacggtctcaaaggccatgggcagccaggacgactcctacagctacatagccaatcatacgcaaacataaagcaacaggctgctctcctatcaacatgagggcagcctattgcttttttcatatcccactgtcaaagtctttgttctgtggtgggatgacatggacgaaatatccgtattatggtagaatgaacttaatataagaacctgtttctgatggttcaaaacggaatcgacatcattgcgttggatacctgccagcacaaatcggaatttgagaggagaacaaaatgccttatattacagtggaaagtggagctttatctgatgaacaaaaggaacagttgataaagcgtttaacagaggtatcttctgaaatcatgaaagtaccaaaagaattttttacaattaccattaaagaattaccagataaaaattttggcattggcggtaaaacgattgataaagtaaaggctgaatatatgcagacgcataagtaacttcccatttatcggggagttgaacagagagaaaaatcggtattgaaggagaaatacaaaatgtatattgaaaaatactggggtaattatatcgggggtacggatgacagcctaacattgctggattatttaattgataaacagaaagccgaaatacctctcagcgaaatatttgcggacactggcttagataagctaaactggaactttcacacaacagacgtagaacttgagtacaaaggccatgacggcagagcacatgagtttgactttgctattgatttgtttactgatttggcagccctaatgctggagtgctctatgaatggcagcgtgtctttgggggaactattgaatgatgagaatggcaatattgtccgtattactttcacccaagaagaaaaaaaagctataaacaaggcactggctgactttgctaaagacccgctgacttatgacctccatgagatggtaccggacgaggatatgcaagaaatggcacaggactgtgaaagtctccgtaaagaactgtgtgaataattctccgtttcaacttccagtttgtcaaggagctaagtagaacgattaccggaacagcccattttttatcctgtcctgaatgaacagtacgcaatagagattgcttccggctggaatgtgaaatataacgaggaccacagaggttatgtcacaaagtttgaggtagacgaccaatattgcagacagtttgaagtccatcaggtcgggggcgcgcaacataaggagttatgggtcccagccgaaaagctagatgaatttaatgagcatattattggggaaatacatattattaaagaatttccagataaatagcaccttatcgtgttgactggcagccgaaaaatatggtggataaaatgaccaattacacatttgaggatataaagggattgttactaataagcatccaagagtatggttttgaatcagaattacgcttatgctttcatgacaacccgaatgaatacatgattataatttatgatgaccattgctctttccaacgatgcggcaatccaaaaaaagcaagcggcgaatataattatgaatcattggatgagctgtataaagcccaacaggttgatgggattgttttagaaagggactggggaaagattaaggacttagagtgtaccgattttgacatattggacctatgggactaatggcggattgaacaccctctcccctctctgccggatgtgaatgaaatagaatttatcaggagatgaaaataagccatggaaaaatatgtccctttttcagaagtcagcattgtactagagcaattaaaacacgccccctttctctgcaaactggaggaagcagatgataatgaactgcacatcaccatcatgagcgccacaacaggtggctgcgcagacgtgcatgaagtctgtgaaaacacagctttagaacaaatactgtcccactgcaaaccaatcgaagccaacccagaacagagttttgaaatcatttttgaaaattacatcctgtatcaagtgcgcaatgaatcattctgttcctatgatgcggatgaaatacgttcgggaaaattcatgattgtttttgaaaagtcgaaattactggattatcttatggtttcaacggacgcctgccagcttgacgatgggatgttctatcccggagaatgaaagcattacggcatatacacgcaaagccacataattgatgtggtagcgttggatgagcctaaggtgttttgcagggttcaatagcctgtcgcacgtagatacccttaccacaaagtagcggctaaaacataaaaaagaggtaatatatgaatagaaagcttgtaaaattacttatcgccattaccagtgcttttctctgtcttacaggttgcagaagaaacacggctgaaccgattattcttcccactgttgatgatatctgctccataaatatcgaactgattgatgggaggcagatgtcttacgaaaattccgaaagcatcaaacagattatttcagccatctccataggaaaagcaaccaacaaggaatccgtgcaggattttccgtcagaagatgaatatggaacgataaacatagaaagtaatgatgggacaaccactgttttttattatgttaatagcggaaaatactttgtggaacagccatatcaaggtatttacgaagcagtgggcaaccttgaaaattccctcataaatgtcaaataacaggaatatataatggatactgctctctgactggtaaattccataaagaaatctatatcgctttaaaaaggagctcttatgctatttctgctgatattgactgacccggaattatcttatgataattactcagaggatttttatattggcctatttgaaactgaacaacaggctgaggatactgcccagcattatcttaaaaatataaaagggttctgcgatttcccctgtacataccgtatcgcgaagaagaacgttattggcgattttaacagcaggacatctgatttcctatggactgttcaagggtggaacacaaatgaagacctagatgagatagacataatcgaaagcccatgcttcctcacagaaaaacaagcagacgctgagcttctggtcatgaaaaagaaataccaacgggcagaatggactgtaaccagatggaaattaggcgcattgaaatggcatgatagatttgtcagaatggtttatggtgagcctgtaaactaatcgttatattaaaagtagacaaagaacaatgagcaaatataatgccctatgggaatatgtacagaaaaacggaagccaatctattaaattgacttttgatgaaattgctgatattgcaggcatagccataaaccattcatttttgaaatataaaaaagaactaacggagtatggttatcaagttggtaaaatatctatgaaagagcaaacggtcatttttaataaagtcgaagagtaatttcagtttgtcaaactggaaaattggaattgatggaggcgagaataatgagcaaagagtatataataccagcgtgttcaggaataaaaattgatgttcagcaaggacaaaatattacagtggttgacattgagggcggtcaagtggttgatttttttgcagaagtgacggataaaccaaatgaatttctttcaaccggagtgacgattgactgtaatgaatctttgaaattaaaaattggggatactatttatacaaacttatatacacctatgatggaagtcctttctgatgatgttggcgaacatgatttattacacccatgttgccgaccagaaatgtatgattatttctaccataatggtaaaggacatcgaaactgtttcgataatatcaataatgcccttaaagaacaacggccaattattacacctgtcaatctatttatgcacacgaaaatcaatactaacggcaatatctcagtagaaaagcctatttctgaagctggagataaaattatattaaaagcattgttgaatatcacattgggaattgctgcttgcagtgtttctgaaagccaatgcaatagtggcaaatgttcatctgtaaaagtaatcattgactaacgcaaatttccatttgcaagctgacgatttaaacataaggagaatagaatcctaaatgaaaactatatataactgaacgggtttataatattttattttgcaaacggtagagtgaagtaaaggacaaatcgggattacaaggagattaaatagtgaatttcattgatagggcatttaaacaaaatttatcaggcgatgacttcttacaggctatggcagatatttattcagagccagaagtttatagaattttaaaccaatatccaccctttgtagcagatgtgatttcgattattgattatgataccgctttacagatggatggattagacgatattataagcggcaatttaagtagcaggtatgcagaaatcctaaatgctcttaaacaatgtggtgccgaacaggaagctgatatcttaaagcacgcgaaggaattatacgattcagacgaagatggttacaatgaggaatacgataacctgaatagccagattgccttacataatgattataatggattttgggacattgtccgggcatatattgataaaaatttgaatttaatctaatctgcacaggtaggtcctttccatcctgtaaaagggccgccgccctcatcctgacatactggatgaaaggcggtgattttttttatgcgtgattttatacggaaccctaaaaactggatggccctctgtgttgtgctggctgtcctctttgcgttgatatactccttcctttcctccaccaatgcaaacctaccctcctacgtggagccccctgccacaccagccgagcagacgccggccgttgacattgagaccgtgcagtttgcggccgagggcatcaatcttaccatgtcggccccggccaaatggacccatgtgatacggcagggggcggatgcctacataaacccggccgacggcgccaccctcttcttccatatcagcggctacgacccgggcgtcaacatggtgaccgaggagattattgcctcggagctctctgcctccggcggcctcctgggcggcttttccaggaacggcaatagcgcttacctggctatttacgagcagggggctgtagattgctttgaatacaccacatgggatttatcaaccctggtacgcatctccctgcaggtccctgccgagcggtatacggactactatgacacggcaatcttcctgttcgacaccctcaaatgggaaaaggagaaccccattccggagggattctccttgttctacagttcctatgggaattttgagttcggcgtccttgatgggtggaatgccgcgattgacaacggggcttatattgccacggctgccagcggctcctgcctaacggcctccgtcacccagtccggcctggacctctcctccctcagccagctggattacgtgggcgccgcaagccaggggaaacagaactacctcctgtccacctattccaacgccggttccacgctcattgcagaagccacttataccaaggatggtgagacctgggtcaacgtgaacaacatacttgccacaggttcctatctgtacgagttttcctttgactgtaagcaaagcgagtatgagaccgacggccccagctttttaaccgctatgaagctgttccgggtgttttaggctcatccagttccattatccggtccagggcgtaacgcacaaactccgatgtggcatggaaccccttcttttttgcatactggtcaacgcaggttttccccgcctggtcataataggccttgacgtatttattcatagacccggtaccgtcattccccttttttgcattggaccagaaaggttccatgccatacctgcccaggaggaagtccagctggtggggctttacgttcatctgttctgctattcccttttttgtagggggtacttcctgtaaggatagcttcaccagcctctcctctatcctgtccggtattggctttgcgctgaaggtcgtcctgggtgcctgccctatcatggttgcaagcagggcataacgttccggggaaaggaccgtccagtttcctatcctgcgcagctgataaggcttgaccttctccccaaagcagcgccggaccagttccggcccatagaacccctcaagcgccttctttaccatatcggaatcaaggatggtgttgaaccgtttcgctatcgtcatataccccttgttgcagaaggcctgcacaaggttattcaccccctctgtgggaccaaccccaaggggcatgtccaggtaggccaacagggtctttgccaacggcatctcatatttttctatatgagcatttggctctatatccttacagtactcgtttggtataaagaacttttcgttgacctgtccccggttgaacggtatccgctccaggcggcatccatgcttcgggcagacagacataaaaggaatctgatggacggtatgccagtaagtttccccatacaggcttacgtcctcctgccggcacaggggacagtaccgtaattcagacgtaccgttggcactgctgtccgtcttccagagccatgtaggcgttattgctgtcccctcacacagctcctttaacgcctgttccttcttttctaccgggttgatacggtaaaagtagggaaacaacgtatggttcagaatgatatccctgatatccagcaatccgggcggaagctgcccgaggatatcgtttatggccttggtcgggtagaatgtccccatggccgcgtgcagcctgccgtcaaacagctcctgtattgtagtggcggatttcgtatggcctgtcctcatgtggtagcggcacagcacgctgtaccagagttcgcccggataaggcgtaggaaagaaattcagcacttcaccacctccagcatgttgtatttgtccagggccgacatcattgcttccggggacctggccagcttcagcagctccaataagtccatggggtcacgctgcgccttcttcctccccctgggctttgcatagaggcgtgggacggtcccttccaaggcttccgggccatccgtatcagcaatggccttaatgcccccattcatcccctctgcaggcccttttacttcctccacatcatcaaccggctcatatccggcctcatccgtgaaatcggatatataggagcctttggcatacttcttcggtatctcgatggacagcagcctgaccgccctcatgatgaccggctcgtctataatctccttcccggtcaggattgcctgcacctgtgcctcctggaatatcttgcagatataagccgggatgcccccagaatagtcatatatgaggtttgcaagccggtccgtcagccctgcccttttccgggtgaactgataggcccatatgattttaaggaaatcccggtataatccccctggcttcaatggaagcagccgcaggcccctggtacgccgcttcagatgctcctgggaaataaacagttcctcggccatcggggtgcccacgaaatagatactggtgcttgtatcgttggtcagctccaccaggaacttaaccagcggcttgacctgcttattcctctgtgccgtggccacggcgttctgtatctcgtcaatgaccagtagcccgatatggtggttcaggcagatgattttgacctgtgtggccagggcgctggcggatgtgctccgtatccttgtggatgcctcataatactgggaccccatggcccggtccacggcctcaatgatgttgaatgccagggtcttcacggaacagtcgctggggcattccaccaccaggtgggttatctgtttctcgtaaaacggcctcccgttgtatttggtatgtataatgacctggggtatgaggtccaggcaccgccggatggtcgaggtcttcccaatccccggcacgccgaggatggacccgctttccccctgggtggcaaaggaagggccgtttccccgggtcccccctgaaatcctcatggatggcattcagctgcctgactgattccatggtggtcctggtcgtataggtagtggtgactgcccggtatagtgtatcatagatgttatacatatagtccatagggtaatagacgctctggaggaccggcagatgcctcctccgttcctccccactgagttccgccaggtcatagggcatcggcggcaggcttgcaatcttctcaaagaacctccccttatccatcagttccggcatcgcttccaggaaagggttcaacacctggcctccggagccgaccttatcatatatggctgataccactgtcttttcctgatatttcatgtcaatttccccctttcatccgcacggttctcccttatctccgcgcccttctgccttggcttctcaacaccgtcaatctcgtccactatctcctggatgctcttgatgaccgcgaccctggcctccgtatcctgctgttccagctccttcttctgccccttcaccttgtccctggccatttcatactccatctgggaaagaccgttaaactgggcggaggacaatgccagcgggaactgaacatacttcccatccctcacccagtacacggcgtcaattctggacgggtcataggcaaccgtaatctccttatccatcccgacctcctgtaaataccgcctgtattcattgttcatatagctgattccatcacgcacaatccccttgcgcgtgaacttcgtaactatccgtggaagggtcatccggtacaggtcctccccgcctgcagggatgatgtccgccttcccctgcctctcatgccactgccaaagggctgcgggtatcggctccacccggtccgcgcacatctccggcgtaggtatgaagttcttcagtatcctgtgcgaattgatatagatgacgcagtgcaggatgaccctggtaaactccgtcaggttcagaagggcctgcgaccggtagtccgtagcccagcgctcctgggcatccccctcaatgacccccttgccgcgcaggaggggcttgtacttctgctgcagcacatcgaacgtcttttccaccagccccttctcgtccggccggaacggcggcagggcctctcgctccatgccgtatatggtacacagctcccccacccttgaggtgatgaactccttcccctggtccgttatgatttccccgggcagccccatgttcggccactgctccggggttatttcaatcccaaagcgcctgcaatactgcaccttgtcggaggcagcgtttgccaggcaggccatgactgcggtctccccggcatcaagccctatgttgatgccggcaatcagctgcgtggccgtgtccactgccatgtagatgttggggcgccccaccacggccgtgcggtcaaagcgggacaccaggtagatatccgcctctgtcgcatccatctggaaggcccctatcctgtccttccactgcatggtggcgccgtacaggggccgctcattcctctggtagtttgacaggccaccccgcgatacagagcatttgatggagcggttatacccatgccggtagtaatagtggcggaacctgtcccatgaaggggctgaatccatcaacttcccctctggcgtcatataccggcttgccagcatatggtcataggtatccctaagggacatccgtttggcgctgaagtagaacttccggatggcccaggcaaagtttttctcgtctaccccaggtttcctgtcccggctccctttctccataagggtgttccttgccatataccggtaatatatgcgaagcaccctcttttttgttgtcccgttctctttcgctattttcttggccatatccagccggaattttttgtccgtaatgcagctggaatcctccaaaagtggttcaatcagggcaaggcgctttatcccggcctttgtcagatactttgcctgctccagggcaatcctgtaatcctccggcatatccgctttctcacaggactccaagaggctgttttcaatatagcgcggcggccccggttcatcatatgaaataacccaggccccacggtccagggcaagcagccgtctgaatacttcaccatttatcctatagaacatagccatcccctcccctggccattaccacgaccttccaatcatctacatcaaggcgtttccagtaccgccttgaaagctccagcttctcaatggatgccctcctggtcagatattccgctggaaccacttcccttatactgatgctgccatctgcattttctatcctaaagtcagacgcccaggctgcctcaaagtaatccggacgtatttccagcctggagatttcccctaagaatgctgggtctaacggctggaggcattgatatcctgccacatttgggctgtcctccaggatatcagcatatgtttttgcatcacgggtatgtactgatatcaacatctggttcttctcactgtaaaactgtatatccctgtattttgactccgtcttatccatatgtactccttactcccgtcctggccattcaatgacctcataatctcggaaggcgccgcacctcgggcatggggcgcttcccctctgaatcatctcctcggtcacctcgcatatctccctctgacagcaatccaccctgactttggggaaccgtctcccctccagcacctccggccgaaaacgcctgttgaagcggagataatcaacccagccctcgctgtcaaatatccggttgctgtgcagctccagggccatcttgtgcacatcaaaaccatgccttgggtaatgcttcatctcccggtaccacgtctccaatgcctcaagcagccatgtctcaccatgcagcccaatcacctgctccgccagctgataccagacgtcctccctgatatcaccgatttctgtctgcacccccttacggaagaatttctccttgtcccttcccctgcctttggtcattcccatcccagtcccgaacatgaactggatatcctccaagctaatagaagggatgtcgatatccgtaagcgcattaatttgccgtctgtccatccttgaattcctcctttccggaattaatccgagtttttgcaattaatccgagtttttgcatgaattaatttgagtttctgcaattaatccgagtttttgcacctattaatttgagtttttgccgaaaagacccctttttcatgcaaaaactcggattaattctaattctaagtgcaaaaactcggattaattctatttaattagagggtctatgttgttgtgccaagtaaaacaggcactttctgccacaaaatggacatatatgacagaatttcagcctcccggccccctgccgcccatctcccgacccagggcttctgcctcatatccaacatattccctcttcctttggttcctttttcctccccttccctccggccccaggcagtcccgtaactgccagaaagcctttgtttatgcgggttttcagcctttgcctccctctttttctccctattataaacggcatatggcccggtgccaggcttgacggccgatggccccggtgggtgccggaaacagggggccagggggtggttttgcacacgaaaaaaggacccaaagtatggttttacataccttaggtccttattttatccttttttttgcctcaaaaatggtccattttgtggcataaagtgactattttaggtggcaggatgacaatcaattacatccccatctgcttcgctacttctgctgcaaagtcctcattctttttctccaggccttctccggtctcgaaacggatgaacttcttaaccttgatgttagcgctgttagccttagctacagaagcaacatactgggaaacgctctgcttgccgtcttctgccttaacataaacctgatccagcagacaggtctctttcagctctttgttgatacggcccttaaccatgccttcgataatcttgtcattggcatccggcttctcgttcttagctgctgctgtaaggatttcagtctcttttgcaatatattcatcgctaacttcatccctgctggtgaacattggctttaatgcagctgcctgcatagctacgttcttagacatatctttgatttcgtcattgataacgtctgtctcaacatcaatcagaacaccaatcttaccgcctgcatggatgtaggaagcaacaaaaccatttgcctcttcaacctgctcaaagcggcggatgttcatgttctcgccgataattgcaatctgggatgccagggcttccttcacagtcagtgtctcatccttagcccacttctcttccaggaacgcatccaggtccttagcgcttgtaacaagtgcctgtgctgccacatcagcaacataggtctggaacttctcattcttagcaacgaaatcagtctcagcgttaacttcaactacaactgctttcttatggtcatcggttaatgcggtagccacgataccttcagccgcaatacggccagccttcttagctgctccggcaagtcctttttccctcaggaactcaacggccttatccatatcgccgtcagtagctgcaagtgccttcttgcagtccatcattccggcaccggtcatttcccttaaatcttttaccattgctgcggttactgctgccatttcattttcctccaattataagttttagttttttaattaagcttctgctgcctcaaatgcttctgcagaaatctcaatctccattgcaccttctaaaacttcgccctgcttcgcctcaattacagcgtcagccatcttggaaacaatcagcttaacagccctgatggcatcatcattgccagggatgacgtaatccagttcttccggatcacagttggtatcaacgataccgattaacggaatacccagggtgtgtgcttcctgtacgcagatatgctctttcttaggatctacaacgaagatagcatctggcagtttcttcatatccttgattccgccaaggtttctctctaacttatcccactcttttcttaactcaatgacttccttcttcggaaggacatcaaaggttccgtcctctgacatggtctcaatctgtttcagtcttgcaatacggctctggatggtcttgaagttggtcagcatgccgcccagccatctctcattaacatagtacataccgcaacgctcagcctcagccttgattgcttcctgggcctgcttcttggtaccaacaaacaggatggtgcctccctcagcagcgatatcggatactgccttgtaagcctcgtctactttgcccacggacttctgtaagtcgatgatgtagataccgtttctctcggtatagatgtatggagccatcttagggttccatcttcttgtctggtgaccgaaatgtacaccagcttccagtaactgcttcattgaaataacgctcatgttctttacctccatttggttttagcctgctacgtttcacgtaagttcaggcacttccgtccgcttctcatgtttcccggaagacctgtccggatattgattcccagttaaatgatggtttccaatatacttcaaggcaccgtcccgtagaatccacagacgtgttttttgtcagccttatcaatatatcacaaaaaacagcagcttgcaagcacttttacgtgttttttgcaaactgccgttctgttttggctttttatgttatataatgtggtctgacctgacattactgtatcatgggggtgctatttcagatttgtgttggaggccttaattgccttcaattcgtcaaataccacatcattcagaaccttgatatatgttcccttcattccggaagaacgtgactcaatcacaccggcactttcgaacttgcgaagggcattcacaatgacggaacgggtgattcccacccggtcagcaatcttgctggctaccaggataccctcgtttccatccagttcctcaaaaatatggatgattgcttccagttcagagaatgacagggtactgatggctgatttaacaatctgcaccttccttgtctcttccgcattctcttcattcacggaacgcatcatctccagccccacaaccgtggttccgtattcgcttaagatgatatcatcaatatcatactgggagtctgacttgtaaataaacagggtgcccaggcgttctcctgcaatatcaataggggtgatgatggcctgatacttccttacattctcttctgcaaagcccagggtagccagattcacattctcctttgtcgatagcacgctgaggaggcgttcattcagcatcttatccacgtaccctccaacctggtcttctatcagttcctctatctcatccacatcggagttgatacttacacccagaacctttcccttcttactgataacaagtatattggataacaatatctcacttaaaaccttacatatatcgttaaataccactttatgagaattgttgttatgcaatagcttgttgatttttctggttttgtccaacaattgaacactcataatcgaaaacctccttatccaatttgtataacgccccaaaatactctactaataattgaattttaacacaatttttaagcaataacaagagttttttgaagttttcgattattttaagattttaataattttcggttctgttttacaattttttctatttatccgtgctatccggctgatccttcttatccgtgcggtatccgcaggtctcgctggaacagagcagtttatttcccttttccaccatgtaggaaccacagttgggacacttctgggtggacggcttttgccaggacatgaaatcacattccggattatcctcacatccataatacaggcggcccttcttggtcttcttaaggaccacttccttaccgcacttgggacagggtaccccaatcttctcgaaatagggctttgtattcttacagtccgggaaaccggggcaggcaaggaactttccatgggggccatactttatgaccatctggcggccgcagaggtcgcagacctcatccgacacctcatctgcaatcttgacggattccagttcctgttctgcaatcttgacagcctcatccaggtccggataaaaattgctgaccactgttttccatgcaacggtcccgtctgccaccttgtctaacagggattccatattggccgtgaaattcggatccacaatgcttgggaaggaacgtttcatgatgcggttcaccacatcaccaagttccgtgacataaaggtttttgctttcttttacaacataccgcctggcaatgatggtggtgatggtcggggcgtacgtacttggacggccgattccctgctcttccagtgcctttaccagggaagcctccgtatagtgggcagggggctgggtaaaatgctggcttggcttaagttcttccagcttaagcataattcctttttccaggttcccaaggacctggttcttttcctcttcatcgtcagcttccacatacactgacatgaatccttcaaaagtcagtctggaagcagatgttgtgaatatgtggctgcctgcctcaattttcacggaagtggtctcatatacagcagaagccatcctgcttgcggtgaaacgtttccaaatcaactggtacaggcggaacaggtcacgctgaagggattccttaacaatggtaggtgtcaacgtaatgtcagttggacggattgcctcatgggcatcctgtatcttaccattttccttcttcacctggttaccctgggccacgtagtccgccccataatgtcccttgacaaattcccttgcggccgcatctgcctcatccgcaatacgggtggaatccgttcgcaggtatgtgataagacccagtgtcccatgtccctttacctcaacgccttcataaagctgctgggcaagacgcatggtcttctgtgtggaaaagttcagcgccttggatgcttcctgctgcagggtactggtggtgaaggggattggtgccttcttgatacgctctccctttttcacttcctctacctgataggtgcagccttccagttctttcaggatatggtccagttcctccttattgcggatagtggcctttcctccttttgtatccctagaaccataatacttggctgccagaggcttcttgcttcccttcatcagaaggtcggcctccaggttccagtactcctccgggatgaatgcgttaatctcatcttcccggtcacagatcatcctgagggcaacagactgtacgcgtcccgcacttaagcctctttttacctttgcccaaagcaggggactgattctgtaaccaaccatgcggtccagcatccttctggtctgctgtgcgttcaccaggttcatatccagggttctgggggttttaaaggaagccttcaccgcattcttggtgatttcgttaaaactgatacggtaaacatcttttcccttctgctcatccagcttcagcgctttcatgagatgccaggaaatggcctctccttcacggtcagggtcagtggccagataaatcttatcagcctttttcacttccttgcgcagcttggcaagcacatccccttttcccctgatggtgatatacttgggttcatagtcatgttccgcatcaaatccaagctggcttttgggaaggtcccttacgtggcctccggaggcatccacctcatagttattgcccagaaacttcttgatggtctttacttttgctggtgactccacaattaccagataatttgccattgtaaaactccttattccctcttcatatattgataaatacgtaataatgcttatggttgtgtcatccgccggatataacactgaccgttggtccgcagtgcaaatccacccagttccagttcacaaagcgtgctcatgcactggcttacaggaatccctgtctgcatggcaatctgttccaggtgcctgggttcggaatctaggcaactatacaccattttttcaaacttggcaagtcccttatctgctttttcgtaagaaaacattggtttttcgtaaaaaatgcccatagattccagcacatcaactggtgatgtgagtatccctgcaccggcccttatcagataattgcagccttcgctcagggcatcggttatccgtcccggaagggcaaatatctcttttccctgctccagccccagctgggctgttatcagtgaaccgctcttctgcctagcttccatcacaaggatgacgtccgacaatccgctaatgattcggttccttgcaggaaaattacgcgcccgcggttcttcatccggtgggtattcagacaggatacctccattttccagtatctgctcaaataatctgtaattggttcttggataacagatattgacgccgcagcccaatactgcaaatgtctttcccctgccttttacagcaccttcgtggccagccccgtctatccccagtgccagcccgctgataatctgtacgccttgtgcggccagttccctgcccatgtattcggcggattgctttccatatgacgtacagttccttgctcctatgacagcggccgacggatatccgtccccgggcagttccccttttacatagagtcccatgggatagtcatagatatgccggagccgctccggatattccgtgtccaggggtgtaatataccggattcccttttcaccaagggtatgatactcttgccgcattggctccagctgtttcttccaggcatcaaattccgggcattgttttgcactgtaaaggattcccatacggtataattccattccttctatataatatacggactcaaaactttctgcctgcttccatatcttttgtaccgtaaccgcgccaaaaccagggcacctggtcagccagtaaaggaactccctttccctctctgtcctggctgcggtatactccatcccatcccatcgctgtgctatccccataaccgttcctccagcattccatagcccaatgcttctgataaatgtttcctgctgatcaaaccgcatccatccaggtccgctatggtccttgctacctttaatatcttgtggtaccgcctggcgctgagctgctttgtctcataaaccgttttcaggaaagaaccttcttcctgacccaatgtacagtattcctgcgtttctttcatccccatcctgctgttaaaccgtatccttgtgccgctgaacctctctgcctggatattcctggccctctctaccctgcgcctgatggatgcggagtcttccccggttcctcctgccccattcaactcctcatatgtcacaggcgaggcatccacacatatatcaaaccgctccaggacaggccttggtatatggtccagatatctctggatctgcagttctgagcagctgcatcttgacctgtcggggtaaaaaccgcatggacacggattagtagcagccaccagcataaagtcggccgggaactcataactgccatggaccctggtaaccgtaaccttatgttcttccaggggctgtctcagaatatcaattgcacccctgctgaaatgcggaagttcatccaggaacaggattccgccggatgcaagggaaagctcccctggacgcgcctgggctccgccgccagtcaacgccagcggtgtgatggtatgatggggactcctgaaaggacggcgggataaaagcggccggtcaggaggaagaaggccgcagatactatatatctttgatatctcgatatcttcctccctggtcagggagggcatgatggtgggaagtcttttggcaaccattgtcttaccggttccggcgcttccgttcataagaagcccatgcataccggcggcggcaatttcagcggcccgcctcagtaccagctggcctcgtatatccctgaaatccacatcataagtctcttccaatactccttcttccatcgatggtgtgcattgccctatggatgacggctgtctgagcatggcggccatctggcccaatgattccaccccgatgattgacatgccctcaatcatcattccttccctgacattagccgcgggcaggaagcagcgtttcagcccatattccctggctgcatccaccagaggcagtacgccgcttataggtttcacgcagccgtccaatcccagttccccgatgaccaggctgtccttaagttcccgggtgtcagcctgttcaaaagcgcccagtactgcaattgctatgggcaggtcataagcagtccctcctttgtgtatgcctgccggtgacaggttaaccgttattttctttgcctgaaaccggaacccggaattgcgcagcgccgtgcgcaccctttcctgggattcccttacctcggaagccagctggcctgaaatggaaaatcccggcagaccgttggaaacgtccgcttccacggagacgacatagccccggacagcccgtatgcctccgctgttgatttgtgtaaacatccatatgcccccttctctttgattggtcttacatacttacatacaaacagtttggaatgtggcgtaaatacccgccggatgacttcttgacagaacaggaagatacctgttccaatgaaatacagatagtattactatactaaaagaacaacaaaaagacaaggggcatgattggattcattttaacgttctctttggaactctgtcatataggccctgtaacgcaggggcaggtggtttctctggcagattggatttgtcctttctttaattgcaatggtatggaaaaaggaaatccacaaatcctcgtattcccgctcatccgtttcctgctccaggcacagctgccatatattgtccccatccggctgttccaatggatgattaaccagaatccacggttttcccttggggtggacagctgccttctcccggttaacgtcataaataatccaattttcttccggcagccggtctgcaaaatgaggcgcaagaagggtcatcacatcgtttttcggtccaatccttgacaccagcacaccgcccgctgcctgggaaaaccgcaggaattccaccagaagatggttctcattataaacattgcggcacagttcaaatatatcacagttctcaggaatctgaagctggtccagtatccccggtccaatgccaaatgcctgtacaaggaaacggtatatcttgtccgccctctccgtatcctggcttaaggatgcaacatatatcttcttatatacttcctgggaaagcttactgcacacagacttaattaccttatgggccttctcatgggtggattccggctccacatactcgctgaacagttccagttcatggtacgtcccctttaactccaggcgtacattgtcgtggcctttccggctcatccatgcatcatatatgccgcaaaggattccctcaaaatccggcacgcataaatatatggtcattccctatccctcccttatcctaaaaatgcccggctgccgcggcatagtggtcatctctggttacaggcatctccatatgcatatcgtcaaacagggaaagctgcctgaaactgtccctgtgttctatatcccatctggcccgctgctcatcgcccacaaggcaattggtaatataatcctggtccagccttgccccctccatcatgcgcccggaacaggtaatgaaatatctggccctcttcaagaccacacccatcttcttcaaatcctcaaacccaagtcttccgcttcttctggcagcaacaatcctggaagctgacttgacccccatccccggtaccctgagaagttcatcataaggtgccaggttcacttctaccggaaagccttccagatggcgcagggcccagtcacacttaggatccagaaatacgttgaaattcggcctgtcctccgacagcagttcctcagccctgaagccgtaaaaacgcagaagccagtccgcctgatacagcctgtgttccctgagaaggggcgggcctcctggaaggcttggcagacagctgtcctcattcacaggaatataggcagaatagaacacccgcttcagtccaaagttctggtacaatgcctgggtaaccgacatcatctgataatcattctccggcgtggctcccacaatcatctgggtactctgcccagccggtacgaatgctgacttcttatattgggaagcaggaagcacaagacggcttttaatgcatccggggcgggcatccggttgggtggtatacatatcgttatgtgaatctccccccggcacgccctggtccgttcctgccagtccttgggactctccctgcccagtaaccttcgcggatatcttcctgtccagtgcagcacccggcgcctcagccagttccgggcgtatcagggcagcgcctcctgcaaagccggcgcgctccgtgctgtaaggcttcttatatcccctgtcatatcccagtaaatggctggacacggaaatcccctgctgaatctgccgcatgggtgcaagtatcttatcccgggtcttgcccggagccaggtccttaagcccctgagcggttggaagttccagattgatgctcatcctgtctgccaggaatccggtgcgctccaccagttctgcatccgttcccggtatggcctttacatggatgtaaccgttaaagttccattggttccgtagtttatataaagtctcgtatatcagttccatggtgtgattggcattatagaggattccggaacttaagaacagtccctcaatataattcctcctgtaaaactcaatggtcagtttacacacctcgtccggcgtgaatgccgtcctgaccacatcattggaacatcggttgacacaatacttgcagtcatagatacactgattggtaaaaagtatcttcaaaagggatatacatctcccatccgcggcaaagctgtggcagattccggcctccgatgtattcccaatgcttcccgcctttcccttccgcttcacgccgctggaagtacaggccacatcgtacttggctgcatctgtaagtatcttcagtttttcctgtatggacagattctcctgtattaacatggcaccgcctctttcgaacatatgtttgttcatacagtttatcatatccggacacttaaatcaaggagaaatcagaacattcgttctttttgcacaaaatctttttgaacagaaagcctgcggccggaatcatgttccagccgcaggccatcctgttatctgtatttaattaatccctgtatccgtccgggttcatggactgccatttccaggaatcagcacacatttcctcgattcccttttcagcaacccagcccagttccttctttgccttggcgcaatcagagtaacatacggccacatccccgtccctgcgcggcttgatttcatacttcagtgtcttaccgcaggctttctcatatgcatgaaacacatccagcacactgtatccaacgcctgttcccaggttgtagatgctgacgccctccctgtcagtaagcttcttcacagcctttacatggccctttgccaggtcaaccacatggatgtaatcacgcacaccagtgccatcgggggtatcatagtcgttaccgaatacattcaggtattcaagtttcccaacagcaacctgcgcaatatagggaaccaggttgttggggattcccttggggtcttccccaatcaggccgctttcatgggcgccgatgggattgaaatagcgcagaagcaccacattccacccggcatccgctgtatgtaagtccgtaagaatctgctccagcatgcctttggtacgtccgtatggattggtaatctcacccttggggcagttctcggtaatgggtatctcagcagggtcgccgtatacggttgcggaggaactgaacacgatatcctttaccccatgcttcctcatctcatcacagaggatcagggttcctgttatattattatgatagtattcaagaggcttatgcacggactcccccactgccttaagtcctgcaaaatgaatgacggactctattgtttccttatcaaacacgtcctttagcgcaggctggtctaacaggtccacctcatagaacttaaccttcttacctgtaatctgctccaccctctgaagcgccttctcactggaattgtaaaggttgtctactactactacatcataacctgcatttaaaagctccacacaggtgtggcttccgatataaccggcgcctccagtcactaaaatcgccattgtttttcctccttcatgaacacttggttgcagcaagaaaggcagaacaggtgctgaaccgccggttctgcctgctatgaatagtataagggcattgcttcgataaaacaatgcacaattcttctatctttttataatatttttcgaatttcagctttcaggcttaaaatgcgcaggaccgatgcatccagacgatccagcggtatttccccattcccggccccttccaccacagcttcgtaggcagacggaaaatccgccggcatcagaagcatgtccacaccagcctgcagcgccatcaccgccgcctgaccggaggggtagtggtcctcaatggcccccatgttcaatgcgtccgtgatgatgatgccttcatatcccatcctgtccctgagatatccctggattacctggcccgaaagggaacagggaaggtccccgcctgtgattgcaggcagcgagatatgacctgccatgataaaaggcacctggttccccaccatggcataaaatggtttcaactcagcctcctcaagctcttcccatgttttatccgtatatgcaaacccttcatggctgtccccctttgtggctccatgtccaggaaaatgttttggcgccccataaaccccctgtttccaaagcccctcaaggtatgccagggacatctctgtaaccagctgtggatcccggccaaaggagcgcgtctttaccactgtattgtccgggttggtcagaacatccgcatccggtgcaaaatccagattcaatccatattcatgaagatatgcaccaatggtactgcccgcccgatatgcctgaacacggtccccggacgcaccgattacatccatggacggcacctgcgctacccggaagccatcatgcttcccaatcctggcaatatcccctccctcttcatcaatggagaggaacagcggtatcccgatctcctccatagccatcttctgggtatctccggtcattgtctttaactggccggcatcctccagattattggaaaaatagataaggcctccaaccggatactgtctcagcgcttccctggtaacctccccggcctgggtaacctggccgcagcctgtaagctgttccggcgtgatgatgaatagctgcgccgccttttcctccagggacataccctccagctgtttccttgcccattcctcctggctgcttattccgcctattcttatgcctcccccatcatccctgtctcccatcccatattccctgtctttctccttatcgttcctgtcttttgccccatattccctgtctttctccttatcgttcctgtcttttgccccatatttcctgtctttctccttatcgttcccatcttttgcctcatcactcctgccttttgcctcatcactcctggtttccaccccatttatccctgcttgcggtccacggcccccatttgccctgactggaagccggtctgcggagtaaagggccgccacaagtaacaatgtaaccgcagacaccccggccagacggtttttccacacttttttgctgtcttttcttccagaacgcccttttcccatgaactgcttgtctccttttgccttcttaatcaagatgccggctttattttatatagtataaatgattcagcccctcagggtaaagggggaattcacgacaaaagacagcataaaacagcatcggaaccataatcagtcccgatgctccgtattttccaaccttcattgcttatccatgtcttgaaaactccgcccgtatcttctcaatcgccttcttctcaatccggctcacataggagcgggaaatgcccagattgcctgcaatctcccgctgggtatgttccttgcccctgtacagcccgtaacgcattcccaatacggttttttctgtctccgtcagacaggattcaaaggcctcatacagttctttcacatcctgcttcagtatcatggtatccaaagtttctttattgtccatctcgatgacatctaccaggctcacggtctcgccgtccttgtctaccccgatgggctcaaaaagcgatacttctttggaaaatttcttgctggcacgaaggagcatcagtatttcattttccacgcatctggctgcataggtggccagtcgcgatcctttatcggcattaaacgtattcacggccttgataaggccgatggtcccaacagacagcaggtcctccatatcataatcagagccctggtacttctttaccacatgggctaccagacgcatattatgctcaatcagcatatcccttgctgactggtcgccctctttgcagcgctccagatactctttttcctctcctgctgataatggttttggaaaagtcttcaaagaaagccaccctgcacattcttaatttcattctatgcgagggcagcttgccaagtgcttttacaattttttcggggcttatactattttacgacaaacatgtctttatactttttccggtccagactgtggttgtacaccagcgcttcatagtccaggaccatgtcctggtacgggcagcgctccgactcagccttgggccagtaataataattgccttccctgtcgtaacagccaaggaaatgcaccactggcaggacttcctccagctggagaaggaaacggttatatggcgtcatgtccaggtttgctcttttcaatacctccgtggaaaggtagacggcgcccagtttccccatgtcctcagaaggcatgtcataattggtccagataatgaaaggcgtctcataccacatcagacggtcctggaccggcacctggctgctgggcatgcccgcgatggcgtcatagaactcatcctccacgctgggctgatggtcgccaaacatgacaatcatggttggttcatccacctgggaaaaatattccagcaggtactggaatgcctcgtctgattttttcatcagggacagatactggtccgtcttggggtattggccctcatatttaccggtaagccatacctcctgttggaaattatcatattcgccttcatagcccccatggttctgcatggtgacattgaagatgaacagcctgtcatccggtgattccttgccctccaccacatcaatcagcctgtcataatccgccttatcgctgacataattgcgcagctgttcactttcctcataaaattcctcatccaggaattcatcaaatcccatattctggtaacactccacacggttccagttctccccaggataaggatgcatggccaccgcagagtagccctgggactttaatgtgcttaccagggaataggtatcaggctttacattaaattggtatgcaatggaattggcaggcagaagggccatggaatcccctgtaaggaactcgtactccgaattgcttgtcatggaaccgaacacaggcacggtcaggctgcccttcaccgtattctccttaaggctgttaatgaatgggaaatactccacattcgtggtaaaatcccctgccgtcctaaggtctgacagactttcattcatgatacatatcaggttcacaggcgtgatatccccgctattgtcagtctgtacattgtccagggatgcaagctgcacctgcccttcttcctccagacggccatgaatctccttcagccgcgcggtgctgtagccatggggcggcttcttaaccacatactgcatggaaaccgcagtggacagcacatatccatattccttataggagtcattgacctcccacatattgatgccccatccacgccccggcaccagggaaataaaaaaccacgcagcaaaaccgcctgtgagggcagccaccgcacctccagccgccagacgctgtctccatcccctgacccgccgcggggcaaaccacaggcctgcgttcatcagcacaactgccatgcacgcaagcttcatttcatgcgaaaccacgaaggcataattccccgccaccgtggccgcggtcttgaaagccatcacatcccaaagcatgatgggccttcccctgaactccaccacaaacgcctctgccatggatatgataagcagtgccgcggaaataaccggaacagcaatccggctggtcccgctgacagcaaaagcggcaagataaagcacatacatccatgcgatattccacaccgccatatcacctggaaccgtggccagattacctgtcacatattcaaacaggacatacgatacacagggtaccagtataaggcacacggttccaaacacattccatatggtttttatatattgttgcagcttttcctttgtcaccaatcccgtccctctgcagcgtttgcccgattttcagggcatgtcccactcgctgcattcctctctgactgagtctttttcagtgcggctctttcggaggcatctctttccaacatgcctctttccaatgcgtttcttccgaacgcatctcttccaaacacatgtcttccaaacgcatgtcttccaagcacatctcttccaagcacatgtcttccaagcacatgtcttccaaacacatcccttccaaatgcatcccttccccgcacgtcttcattaacaaacatatcctagcacaaacatttttcaggttcaagagacaaatgcttccattggggcgaattcacaaaagcttcacatttccagaacggtcttgatacgccgtagatgcccggctgaaaataacaggacaaaaacagatgattccaactacaatcggatacaatacttcccggtaacaatcctcctgtaaaacacaaccgtcagcacagtagccgcaatccatccaaaaggccaggccatccagatacccatgctgccaaagtatcctgtgaggatattggccacgatgatgcgcaggatcaaatccggcaccgtggccagcacaaagtatgccattgccccggaacccctgatgatcccatccgtcataagcttgatggatatcatgaagtacatggggcttacaatgcgcaggaagcccacgccggagcggattgcctcctcactcccgtcccccaggaacagtcccatcatctgtctgctgaagccaaagtacagtacaaagaagggaatggtcgcaaggatggacagcctgacgcctgtcttaaagccaaggggaagccgctcctttttaccggctcccaggttctgggccgtgtagctggacaggcagccgcctaaggacatgaaggcgttgattgcaaatgtattcagtttgattgcgccggaatagcccgctatgacggcggagccgtaacggttcacgatttcctggacaaacatgttcccaacggaaagcacgctctgctgcatgatgctggggacagcgatggcagcaatctgggacagcagcagaaggtcaaaaagcaccaccttccggctggtctttatccccttaagcctcagggccagggtgacaagggccagtccagccgatatgccctgggcaatgaaggtggcccaggcaacgcctgccacgccccagtggaaccctgcaacgaaccagtaatccagcaggatattgccgatggacgagccgatcaggaagtacaggggcgtcctggagtcccctaaagcagtgaaaatcccggtacacacattgtaaaggaacagaaaggtaaggccgaacacataaatcttcaggtacagttccccatccccgaatatattggacggcgtatgtatcagacgcatcatgctgccgcagtacacatatcccagcgcggtgaggatcagactcatgacgccgcaggcaatgaatgcggtgtaaacagcggatttcattttcccaatgtcccttgcgccaaaaagccgggataccaccacggacgcgcccaggttgctgcccactgcaaatgccatgaaaatcaccgtgatgggataggaagcccccacggccgccagcgcgtcctctccggcaaaccgtccggcaatgctgctgtccgcaatgttgtaaagctgctggaacatgacgcttacaaacatgggcagcacaaaccgccacaatgtatttttaggatgtcccactgttaagtccgttatcatacaacatatctcctcattcaagacacttgcttcattatacccctgtgcatggatgaaggcaactgtttttatacaagggataaggcatggaaaaaggccggaagtcctgaaacttaagccttcccgccttttccctgtataccagaaaatgtctgtaaacgattagtggtggaacaatctgattcctgtgaatgccatgaccatgccgtactggttgcaggtttcaattacctggtcatcccgcacggaacctcctggctgggccacgtacttcacgccgcttttataagccctgtcaatgttatcgccaaatgggaagaaagcgtccgagccaagggacacgccggacatggtatccagccaggccctcttctcctccctggtgaacacaggcggttttaccttaaatgtcttttcccatctgccgtcggccagcacatccatgtaatcctcaccgatatagacatcgatcgcattgtccctgtccgcgcgtctgatgctgtccacaaagggaaggttaaggacctgtggggcctggcgcagataccagttgtcggccttgctgccggccaggcgggtacagtgtaccctggactgctgtccggcgccaatgccaatggcctgtccgtcttttacgtagcagacagagttggactgggtgtatttgagggtaatcaatgaaatcataaggtcaaccttggcctgttccgtcagctcccggttctctgtcacgatatcctgaaggagctccttgttaatctccaggttattgtggccctgctcaaaggtaacgccgaatatctgcttgcgctcaatggcagccggttcataatccgggtcaatctggatgacattataattgccgttcttcttggacctgaggatttccagggcttccggctcatatccaggagcaatgacgccgtctgacacctccctcttgatgatcctggccgtagccgtgtcacacacatcggacagggaaatgaaatcgccaaatgaagacatcctgtcagcgccccttgcccttgcataggcgctggccaggggtgacagttcccccatgtcatccacccagtatattttcttcagtacatcatccaatggcaggcccactgcggcccctgccggtgagacatgtttaaaggaagcagccgcaggaagcccggttgccttcttaagttccttcaccagctgccagccgtttaacgcgtccatgaagttgatatagcccggcctgccgctgaggacagtgatgggaagctccttatccccttccataaagattctggatggtttctgattggggttacagccatacttcagttccagttctttcataacaaatccctctctctttttatttgttcttattgacaatccttgtctcataggttcctgatgctatatcaatgaagcggacaaacagggataccttgttatcctcattcaggctgttccataccatgtccgtaaatccgtcaatggtgccggatatgcccaccggctttggttcgccctcaaaacttggaaggggggtcccgtcatgcatataggtatggatgaaacgtccttcccccggagccgggttctcataggcgtatgtaaaacgcaggcatgagtcaggatttccatgattgctctttaaaatggacatggcataattatagccgctgttttcaatgtgcatgataccggaaatacgcggtgtgtaattgggggcatccggttcaaactccctggaccttaaggactgctcaaaggtcatctgatggtccatcccttcgtagaccgtatcggtctggtcgccgttggtcacaattgtcttattgccaagaaccctcacaggagcataaataatgaggctggggtcctccagctttgccgggtcaaatgcctgggtgcggatgccctgtccgtcctccacgaacacgcggttgcggctgttggcgctccttcccatgatgaaataggcggtcactgccttggtcccgtcctcagaacgtcctatgacaattccacgtccgggatatgcattgcttctcaattcctgttccagcgacatctgcttcatagtgtttcctccatttgctgtgattgtttattcctctgtaaatataaaaagagccggcccgccgggcacgctaaaaacacacgtgcccaggcggtcggccaaatctccgtaatacggtccgcgtgctccctgtggttcatccactatccgccagtcacacgccctgttattactatatatcatttattctaatattgcaatagtttattagaagttttactactgaattatccaatcagtcattgcggatggctgccagcgggctcagcttcatggccctcatggccggcatgaatcctgccgccatgcccacaaagatggcaaacccaatggcggatatggaaagccagggcggaatcctggaaaggttgcccaccagcccattggtttcttccagactgacaaacttattgatgatgcctgaaatcccgtaactcaggccgatgccgatcacgcctcccatgaatccgataaaaccggactcaataaggaacatgttgcggatgttgcccatgtcacagcccaggaccttcatgacgccgatttcctttgtccgttcatagatggacatcatcatggtgttggcgatgccgatggccgccacaaacagggacacggcgccgattccgccaagtactgcctgtatcatctgggactgctgcttggaactttccatccagtccatcctgctgctcacctgaaagcccatatcagccacctgggcctggacatcctttacatattccatatcgtccacataaatctgcgcccggctgtataccaggtagggcagcgcttttccctttttgttggtgggctgtcccgggatgacggttcccttcttgaaggccttgcggagctgtgccttcagtccgtctatatcggtaaacacaccataggaatacgtgccgtaatcctgtgggccaccctccaccagcccgattccgtccatcatatacttcttgggaggcttgacccgggtctggctgtcatctgaatcgccaaaactgcccgaattgttcctggactggaagtatgcatccatatcaaagattatgaaaaggggcttgttaaggaagtccacgtccggaagttcaccggtatcccagtatccccttccggtcttggagttataaaaatcctgctgtaccgtattgccaaaaaccagccctgtctcccccggtcccggcaggcggccttctcccagaggaatctgttccaggaacttctgtcccactcccctcagggtcatgtactgcgcctcataggcgccctggcggatgaccacgttcatgtccaggatgggcgagacaccggacacatggttcaggcgtccgaatttctccatcacctcatccgtaatataggtggggtctgatgacttgccgctgccgccgcctcccaccatgacggccccgccgccgtaatatgaaccgccggaaccgccatacacatcaatggtggtcaggcttccccaggaggacagctgctccatgaacatctggtccaggccgattcccagggataccattaccacgatggaggcagtgccgatgatgacccccagcacggtaaggaccgtcctgagtttcctccgccttaaattgttaatgctcatgatcagaagatcaggaaatctcatcgtccacatcctcttccctggctgccttgcgtttcttcttaataaccatggcaacagctgcaataacagccactgccgccactgctccggcaatcaccagaactttatacttgccccagaaggaaggcggctctgcctccacgtccatggcgcccgcctccataccggcatccatgccaaagggatcttccatctcctctgtcacaaagagggtcagttccttttccacaggctctgcggccacgccgttttcatcttcataggtaatcgttatctttatggtcccgtcatccatggtgggtgccacgcccgttagcatgatgtccacattgcccgtgtcgcccggtttgatattgcccacataggcgtccgtggttttaatggaatccccttcaaatgcagccgtcacattataaaggatgacttttcccgtgttattgatgccaaacatcacattggactcagagccaaccgtcatgctgtccggcatcacgtctatggtactggtgctcagcttggcatactgcttcaccggtatgtccaccacgatactttcttccgcgttcttaaactcagggctgtcatatttttccttgatggtgattgcataggagcgctggtccacgcctgccctggccgtgaacctgacccgcacctcggtgctctgtcccgaacccaggtcattgaccaccatggaggaggaccctgacttggttgtgaataccgcgctgtccgataccttttcagattccaggttaaacaggatattgctggcaggaaccgaggtggacgcattcttcatgttcagcaccagttcgaattcattgccggcatagacctgctcaggaaccgtataatagctgtccacgatgagtcttgccctggtcctgtcattagcgtcaaaatcgcccagattgtcctctttgtccttggacacgatatgtacgtaaaaggtcccctcttccgtgtgcaggtcgccttccgaactcaggcggaaggtaatggtatactttatgggataatagccggtgtaggagtccttgcgtatggccatgctgtacggggccgaaacggtttcacctgactgcacccgctcaaaggtcctgtcataattgccgtcattaatctcaaacgggaacttggtgtcatcctctgacagctgcatgctgatggttacatcctgggccgtggtattgcgcttgttgcggaaattaaccgtatagtccatcacattgggatacacgccccggggggttgcctgattctctccgatgacaaagtaattgccttcttttttatcctcctcatcgtctgtcccggatgatgtgtccgttgaaatccagatattgatatagtcgatatccgtaccgccgtcccactccagaagtatggggatgctgtaatagccctgctgtgcgtccctgcgcacattggccgacagggatacgctcttaatattgcccttcttgatattgcccacattcttagccaggaacgtggtttccatgatttcaaagggatagtagtcaaccgtataatccccgttgccccgctcttcaatctgctggaagtcattggtctgaagaaggcttatcttcaggttgtccatatcctcatccgtggcccttacccggaaggaaatggacatggacttgccaatccttccccttggcgccttggttgtggaaatataatcattgtcactggcgttggtgttatagcccagctgatagctgctggccatcacgccggacggacgtgccccggccatcaggaataccattgataccagtataagacctttacgaattttcattggtttcattctcacatactcccttttctatatgggtctcctcagccagcctgccgccggtctctatgcccacgattttcccatccacgatccggatcctccggtccgcataggaagccaggttgttgtcatgtgtaaccatgaccagcgtctgcccctgctccctgacaatcttctgcatcagccgcagcacctccatggtggtcctggaatccaggtttcccgttggctcgtccgcaaatatgatctgcgggttcaccaccagggcccttgctatacccaccctctgctgctgtccgcctgacatctggtttggcatatgccttgcctggtcccccacgcctaccaggtccatgaacttcctggcctgcttcagcctgttccgttttgacacacccctaaacgaaaggggaagggccacattctcaactgcattcatggtgttcagcagattgtaggactggaaaatgaatcctaccttttcacggcggaaggtcaccagctgcttttccgtcatcttttctatatgagtgctgcctatctctatctcgcccctggtgggcttctcaagaccggccagcatgtttaaaagtgtcgacttgcctgatccggaggttcccacaatcgccacgaactcccccttatatatctcaaaatccacaccgtcaagggcacggaccttcatctcacccacacggtaaatcttgtacaggttcttcacgcttatggccactttcctgctgtccgctgccgtcaatgcctctgccgcctcctgctttcccgtcaccggcagttcccttttatccgcttctgacgtacctgtctgtcctgccaaagcaatgctcctttcctgcatattcctgtgccatagtgtacatttccctatttttgtacagtatagcacaggctcaagttcctgttcttctgtattttccttaaagttccttaataattccttacacgggcccatgtccccatgcctcccggtcacatttccatggaattccctgctgtgacagtatatcataaaattttaaaaaagccacgaaaaattacttgacttatattgcattctatgtaagaatatgacgaggcacaaatcagtgccatatctggcaggttccggctatcgcactggtagggtgcgaagtatttcccaaaatcaagattttaataaattcataaaggcaaaggagaatcccatgagacatttattgaatcccttagacttctctgtggaagaaatcgatgaccttctggctcttgcaagggacattgagcagaatcttccccagtacgcccatgtgtgtgacggcaagaaactggccacccttttttatgagccaagcacaaggacacgtttaagctttgaggctgccatgctgaatctgggcggcaatgtattaggcttttcatccgccaattccagttctgctgccaagggcgaaagcgttgccgataccatccgcatgatttcctgctattccgatatctgtgccatgcgtcatccaaaggaaggcgccgcattcgtggcagcacagaaggcccagatccctgtcatcaacgcaggcgacggcggccatcagcatcctacccagaccttaaccgatcttatgacaatccgttccatgaagggacgccttgacaacctgaccatcggcctttgcggcgacctgaaattcggacgcaccgtacactccctcatcaacgccatggtccgataccccaacatcaaattcatccttatatccccgcctgagcttcgtatcccggataatatccgcgaggacgtgctcactgccaacaacgtggaattcgaggaagtaggcaacctggacgaagccatcggcaagctggacatcctttacatgacacgtgtgcagaaggagcgtttcttcaacgaggaagattatatccgtttaaaagactgctatatcctggacaagaaaaagatgaaactggccaaggaagacatgtatgtactccatcccctcccaagggtaaatgagatttccgtggaagtggacgacgacccaagggccgcttactttaagcaggcacagtatggggtatatgtgcgtatggccttaatcatgagattactggaggtggaaaagccatgttaaatatcagcggattaaaggaaggcattgttttagaccacatcgaggcaggaaaaagcctggatatctattatcacctgggcctggacaagctggaatgccaggtggccatcatcaagaatgcgcgcagcaacaagatgggccgcaaggatatcatcaagattgaaggcgggctggataccctggaccttaaggtccttggctacatcgaccacaccatcacggtcaacatcattaagaatgacaagattgttgaaaagcgcttattaaagcttcctaaaaagattaccaatgtaatccagtgcaagaacccgcgctgcattacttccatcgagcaggagcttccccatatattctatctggctgacgagaagaccgagacatacaggtgccagtactgcgaggaaaagtacagcgaattcaagtaggatactggatttagaaggatacggcttcagcaaatataaggctttaaaagtataaggctttaaaaaagataagaaaaaagcccgccgggatacatggatatgtattccgatgggcttttctattacgcggtaccacggcaggcagatacaggacaatcacgcccttctcctcatatggaggatggggaacgggttcccctgcccgtccagtccatcccttttatagacctggaatcccatatgttcatagaatcccctggcgccgggattctgctcattcacgcagacctctgtcacggaaaaatccctgaacatggattggaccattgccttgccaatcccctgattcctgaagtcaggcgagataaacagcatttccagctgctccttgtcaatacctgcaaacccggtgatgacaccctgatcctccgccaccaagagcaccgggatgcttctgagcgcatcgggaacataggctgcaatcatgtcgatgtctgccggcgtcaggaatgtgtgggtggctgaaacggaatccctccagatacgcatcagtccgctgatcatctccgggctgcgctccgtacatattcttatctccatgtcatgttccctaatcccatccctgtcccactgactgcgggcgctttccctccggcccgatgtagatggagccgtcaaaggccaggatcagcaggaagatgggattcagcaggataaggccgattgcgaatcccgttccgtggccaaaggacatggacatcttgacacaggcaatgatgttcatcacaatcgtcccgatggatgcggcataatacaggaacagcatcccgtccatattctcaaggatggccgtggcaacggcaaatgccatgaacacggcaaacatcttcgtattccagaccagcttatattcggtataggtgctgtagatgggaatcaaggctttccagcccggctcccctgccttgttgaatatcatccagtaggcaaggatatagatgatgagcaggaccacacctataaagaacagtaaaaccccaaaacccagaagcagcatgacaagttcttccattgtgtctcctcctatcctctggccgggacaatctcaagccagtagccgtctggatccgtgatgaaataaatacccatgccagggttctcatagcagatgcatcccatctcttcatgatgcttgtggatatcatcaaagtcatccacgtggaacgcaagatggaattcacattcccccaggttgtaggcttcggtcctgtcccttaaccaggtcagttcaagggtgaagtcagttttaccgtcacccaggtacaccagcttaaaggatccgtcagaagcttctttttcccttaccggcaccagtcccagggcttccttataaaaagcaaggctcttatccaggttcagtacattaaaattaaaatggttaaatgttatcatagaattccctccttatcgtgaaatagtaaatccgcattgacacgttgttattatagcacatggttacctgaattaccatatgcaggaaaaaagcagaccggctccacatatatgggccggtcaggctggttcatatgaaatccgtcaggcggaaaccacccatcacttcttcgggaccatgacttccattccgcccatgtagggacgcagcgcctccggaatcttcacgctgccgtcagcctgcaggttgttctccaggaaggcaatcaacatacgcggcggtgcaaccacggtattgttcagggtatgggccaggtacttgcttccatcctctccctgtacacggatcttcaggcggcgggcctgggcatccccaaggttggaacagcttcccacctcaaagtacttcttctgtctcggggaccatgcctccacgtccacggacttaaccttaaggtcggccaggtcaccggaacagcactccagggtacgtaccgggatatccagggtccggaacaggtcaacggtgttctgccacagcctgtcgtaccacatggggctttcctccggcttgcagacaacaatcatctcctgcttctcaaactgatggatacggtaaacgcccctctcctcaatgccatgggcacccttctccttacggaagcatggggagtagctggtcagggtctgaggaagctgggcttccggcgtgattgtatcgatgaatttaccaatcatggagtgttcgctggtaccgatcagatacaggtcctccccctcaatcttgtacatcatggcgtccatctccgcaaagctcatgacgccggtcacaacgttgctgcggatcatgaaaggcggcacacagtaggtgaatccacggttaatcatgaaatcccttgcataggaaatgacagaggaatgaagccgtgcaatatcgcccatcagataatagaatccgttgcctgcaacccttcttgcagcgtccaggtcaatgccctcaaagcgctccatgatctcggtgtggtatgggatctcaaaatcaggaaccgccggttccccaaaacgctccacctccacgttctcgctgtcatcctttccaatggggacgctggggtcgatgatgttggggatggtcatcatgatcttcatgattttctcagacagttccccttcctttgcctccagttcggccagacgggtggagttggcgcttacctgggccttgacggactcagcctcctccttcttcccctgtgccatcagcttcccaatctccttggacagtttgttacggctggcacgcaggtcgtctgcttccttctgggtgacgcggttttctgcatccaatgcaatcacttcgtccaccagcgccagtttgccctcctggaatttatttttaatgttctgtttgacgatgtccgggttttctcttacaaacttcaaatctaacatggtattcctcctgggtttccttgatgtaatgccttttattgccttccattaaaagacaggcattcctgtactgttacaaagtatataacattttccaggtaaataaaagcccctttttactgatttttagtgcatcccatgacatcagccctgtttcgcataacagcatacgccgtccacataggtggcctccacctgaatccgggccagttcatggacaggcacatcaaaggggttggcgtccagtaccacgaagtccgcggccaagcccggcgcaatccggcctttttcattttcctcaaaggaagcatgggcgccttcgattgtaaaagaatcaagggcctgcttaacgctcatggcctgttccatgagatacggtcccacatgatcctttaccgttgtcctggtcaccgcacactggatgcccttcatcacatccggcagttccaccggacagtcggagccattggatgcatgggttgtctcatacagggtcttaaagttatagctggatgcggccctctccttcccgatgcgctcttccacgatatggatatcgtaatccaggaaaatggactggatataggcgtgcagggacagctcctcaaatttccttaactggtccggccttgttatctgacagtggacgataccgtggcggtggtccggccttgggcactctgaaagggctttttcgtatgcagccagtatgtcatccagtatcccgtcgccgatggcatggatggccacctgcatcccacgggagttggcatacccggccatctcctcaaactgttccctggtaaatatagggataccgcaggtagacgggtcatcggcataggggctgcttaagtatgcgctcctggcgcccaatgagccgtcccccagcatttttaatggtccgatcttaaaccacggggttccccatccggtattataccctttttccagaaatcctttcaggtcttttaaggttgtgaactgggactgctcatataccctgaccgtcatgcggccttctgcctccaattccctgtatgcttccaatacccgctcatagggcacattgttaaaggccagcaggtcatcggtctgggaagaagtgaccccgtagcggttcagggcgcgggatgcggcgaggatcatttccttgatatcctccttgtccggctccggcaggcggctgtatatcagatccattgcgttctcacggaaaatgccgtttggtcctccatccgcatccacctcgaaccgtccgccatccacctggggcgtgtcctttgtgattccggtaagttccagggccttggtgttgaccacgcacgcatggccgcaggtcctggtcaggcagatggggtgatcctctgatatttcatccaggtcatgacggtctgggaaacgcctgccgtcctcaaagtaatcatggttccatccccggcccttgacccaggttcccggcctgatgttattttcaaggatgaaatccttcatatattccttcatggcgcccatggatgaagtgtgggcagacagatccgccatgcgcagcgcattgccgtagttcaggagatgcatgtgggaatcattgaatccggcacagacaaaacggccgtccagcttccttacctcatccccttcctccttaaaggccatggcgccttcattggtcccggcgtatacgaaccggttcccttctgtcacaaaggcctcacacaggggaagttcccctgtgtacacggccccgttccggtatattatcctcattatgtgtctccttattctgtcttttccagtttcttcttatcctcatagaacagggggatatcctcatccagggttccgatgcccatgtagcgggccttataatcctttaacagcttgaagtaggtgccggacaggatcagcacgacaaacacgttgataaaggtagggatgccgcttgtgatatccaccagggtccagatgctcaggtccccgacgttaatcaggtacagggtaaggaggaacggcggcagggcgtaaaaatacttgaacagcataagcagccatttcttcagcaccggatggtccttggccaggtggcgcagggtaacctcatagtacacataccagcccccggaagtggtaacggagaaaatgaccatggtggctgtcatgaacacggtcccgaatgttcccaggctgtgctggaacacattgagggccagggtcgcattggttgcgccggaggtccattcccctgtgatcagtacgctgagggccgtgatggtacatacgatgaaggtatccacaaaaacctcaaaggaaccccaaagcccctgctccaccggatgcctggtcttgctggaagcgtgtaccatggggctggtaccccagccggcttcgttggagtatacgcttctctgcatgcctgtggcaatggcctttgacacggtaacgcctgcaaatccgcccatggcagcggttcctgtaaaggcattggtaaaaatggaggcaatggtgggaaccaggttccctatgttaaggatgatgatcaagataccgaacagcatgtagccaaggctcatcacaggcaccagcttgacgaagatcttgctcaggttcttaacgcccctccagatcagggcatagatgaagatgaccagcatcagggaggccagctcctgctttaccccaaaggactgtgccagcacctcggaggtggtaaaattagatgcgctgatgaaaaaggtggaaaagatgccaaggccgaatataaatgccaggggcagccatttctttccccaatggcgctcctccccaagcccgtactccatatagtaggtgggtccgccgtaagggttgccctcctcgtcggtgcggcggtaataaacagccagggtaacctcaacctgcttaatcagcatgcccatgaaggcggtaagccacatccacagcacggcgcccggtccgcccgtggtcacagcggttgccacgcctgcaatgttgccaaagcccacggaaccgcctaccgcggtggcaatggcctcataagggcttaaaagtcccttatcgttttcatcctgaacatggtccttgcgcaggatgcagcccagggtgcgcttaaagatgtaacccagatggcacacctggaaaaacctggaccgcaccgtgacgtaaacaccggtaatgatgatcagtgcgattaatggcggcccccatatgatctcaccgttgagccagtttaaaaaatctgtcatttgttgaatcccccttgtctttagtctggatgctgatgtggattttcggcaaagaaaaagcaacagccaaggccattgcttccatatccggtatcctctgacggaaccaaccaatagcgccaccactttgattaagtgagagtacacagcctgttagactgtatcccaacacatcccgccggcagacggaacctgtttcggcggaaaaccctttccctgtacgcccggcctgccggccgtggaacgtatgcatacgctccctgacttatgtcgtgtacgggtactgatgtttaccgcgcctctatcgcatcctattttattaacgattcattaacatcatactatcagaagccggaactgtcaacatttttcgctttcatgcctgctgctgaccgcgtggatcagcacgtccattacttcctcaaagcacaccccgttggccgtgggaatgtttaattcctcggaacgcctgatgcactgcttgacaaaggaggctgccaggcgtaccccttcctcaagcttccatcccctgacggctgccgctgccaccacggaggaaaacacgtccccagttcccggcctttcctggcccacccggattgtctttgggaatgagatctcccgttccccttccgccaccacattcacaagatagccgccctggttcacgccggttatgaccacggagcctggtcccatggcctggatatcccttgccatctcctttagctcctcccttgtccagccctttttgcggaaaggcctgtccgtcaggatacaggcttcggtcaggttgggggtgacgatgctccccatggataccagggccttcatgcgcctgcacatggcctgtgtataggtggcataggtctccccgtggtcgcccatgatggggtcgatgatgatttttgtgtcctcatggccaaaatcacggatcatatccatcactatcccaatctggtcctccgagcccaggaacccgctgacaatcccgtcaaaggacagatccagctctttccatttttcaatatatgccggcatcttcccggtataatcgtcaaagaaatagaccgggaaaccggtatggttggaaaggatggaggtggggatgggacagcactgcaccttcatggcggatatgatggggatagccactgtcagggaacagcggccatatccggataaatcgtttatcattgcaatcttcttttgacggtatccactcatatatatctcctaactatcgtagcctgtcaaacagtccggcccgtatgagggcgctgcgaaggggcatgtagattgccacggaaacaagggtggaggtcacggcattgatggaggtgctggtaatgttccatgccagtaccagctgggccgcgggcttccccagtatcagcagcttataaaaatatcccaccatggggtcaaataccacgttgaacagcagtccgcacacagccgcagccagtacatagcggaataccttcttcttatcactgatttcgttaatcctgccaagcttatgggccaccaggccggttatcaggccgatgcacagcttgaggatgaatgtcttgggcgcatataccacatagaccgggtcaaacaggtcaccgatggtcatgccgatggctccgcccaggccgccgtaaaaaccgcctaacacaagggcgcccagcacacacaccgcattgcccagatgaatggacgtggcgtccccgcccggaagggtaatcttaatctgcaaaaaggtaaatacaacataggacatggctgcaaacagccctgtcagcgccagcttatatagatgcttatcctccgcccccgcatatcccctggctgttatctggttcactttcatactctttcactccttggaccgcactgcggtttatttttatgatgattcaatccatggacttcatggtccatatcttatcaccggagtggagtgttataaatatccagttttatgctttttaaccagtccagttctgtcagggcatggatgccgtctcagtcatgggattccaccacaatcagcacgccgtccgtaaagctgatggtgccttcctccccggtcagctcattgctgatgcacaggctggtaccgatttcaatatccttgtcggaaagaggatatttgaatccggtcagcgtgatgccgtccacatgttcggtcaacggaaggaaggaaacgtatctgccccacagcccgctgctcctgaaggtatgataaccatcaatcaggtatatccggttctggctgtccaggatataggcctctatccctttctggaggcaggggaacagcaggtggatattgcccagcatgtggtccatgcgcccgcctgtggcccccagtatcactatctgggtacagcccgtggcctgggccttcaaaagcgccagttcggtgtcggtctcgtccttttccggctggtgggtatcccagataatgtgttccttctgtctgtaatattcaagtataccgggcttcaccgtgtcaaagtccccgacaatcatgtccggttccagccccagggcctttacggcctccagcccggcgtccaccgcgattattttatcaaaatgttcctgttccaaaaaagagccggcgaaagccaggtccagttttccgccggtaatgatcagacatcgtttcatatcacttattccttacttggtcaatcatacttgattcatccattgtccgggttcctgcaaaggctcattccatggagctgaatatctccaggaactcctttgtccttgcagccgcatcaccgccaaacacagcggaaccagccacaaacacattggcgcccgcatccatgatttccttcacattgcgggcgctgacgcctccgtccacctggatatccacaggaagtcccagctggtcaatccttgccctgagcccccttaccttgtcaagggtgtagggaatgaatttctggccgccaaagcccgggttcacggtcatgataagcaccatgtccagctggtcaaggatacagtccagcgcctggatgggcgtggcagggttcagggcaacgcctgcctttaagcccagatccttaatctggttcaccacacggtccagatgggtacaggcctcggcatggaccgttatgatatccgccccgcaggccttcatatcctccacataccgtcccggctcctcaaccatcatatggacgtcaaaaacagcgtccgtgcaggaacgcaggctcttgatgaccggcatcccaaaggaaatgctgggcacaaaggccccgtccatcacatccagatggatgtattcagcccctgcctgggccacggtcctgacctgggcgcccaggctgccaaaatcagccgccaggattgacggcgccaatttatagtacattgttaatacctcctctttttcttaagctcatcatacatcagaagataattcccatagcggctccggctcagcctgccgtcctttagcgcttcctttaccccgcacaccttctcgcccacatggacgcacccaaggaacctgcagtcttcctcatactgggcaaactcgggaaaataatccttcagttccccttcttccagatccggggtgaacatggaactgaatcccggggtgtccatcatatacgtattttcctccacatagaacagctgggagtggcgggtggtatgctttccccgctcaatcttgtggctgatatcccctgtctccatggctgcccggggctggatgcagttggtcagtgaggattttcccacacccgaagggcctgccaggactgaggtttttcctctgaggattttcctcacttcttccacacctgtctcgtcaatggcgctgatgaatttcacctcatatccagctgcctcatagatgcttctgtaggtccccatcagctcatcatcccctaaatccatcttgttgaaacagatgatgaccggaacctgctggatttccatcatgaccaggaaacggtccagcaggttcaggttgggggacgggtgggtcagggagaagaccaccagggcctggtctatattggccactgccgggcgcaccagggcattggccctgggaaggatggcgtcaatattgccctccccctcagcctcgtccaataccgagaactccacattatcccctaccaggggctttatctttttattcctgaaaattccttttgccttacactcataaatccggtccttaccatcatgcacataataaaaacctgcaattcccttaattatcttaccagtcataaactcctcttatcccaccgggaaaaatgttaccggataggatgctattacagtcaggtccgcacttcctgcgtccaccacttccacggtaccgctgtccacgccataggcgcccttaatcctgggaatcaccacaggtatggtctgcgcccctactacaagcctttccttcatgagcggtgtgtataccacatccccgttaaccgtctgtttcagccggatcatcacccggacgctgctggtctgggatgccgggcctatataattgctcagggaacaggtggtgtcgatggagctgagatagtactgggacgcctctgtctccgatgcgtccggttccccgcttatcacataatccacaggagtgcccggggccagcatggtatccggcagcggcacctggttgatgaccagtccttccgccaccgtatcgctgcgctccgttgtcacattgccggtcacaagccctgaaccagccaggagggcgtccgccgaaacccggtcctgtcctatgaggttgggcaccctgccctgctcattctccactcccttgctgacaaaaagggtcacacgctcccctatcttggcagtctccggactgaagcgcaggatggttcccgctgccgccgtattgctgaattcttcctttacatccaccacaagtcccttttcctccagaagcctggatgcatccaggacagtcagcaccgtaaggttcagtgtgccaaggtttactttatcgctccccttgcttaaggtgacccccaccgtgcttcctttatccacaaccgtatcctggacaatggtctgggccatgacctggccttccgcataattatccgaataatcacttcccgtcacttccagcttcagatccacctgtgccagctcttccctggcctgctgttccgtcatgctgaggatatagggcacataggtctggttatccgtaatgttgacctccaggctggcagtctccgcttccgtgcttacagccaccgtgggtttttcgctggttcccgcccggaacaggcctgtgagccttgaaaacacgaacaggaccacggccacgatgatgatggccgccacaatgccgatggcagtgacaatgcgctcaaactgcgtgctgacgtccttgtccttctgtctggatgtcaggtgggaagggcctttgcgttccctgcggtttctggatgaaggatcggggtggtcatccctcagttcctcctcgccaaggcttcccctggccggtttcctgctttcctgaaggttaagcagttcttccctggatatggacctggtcctgccaaactcatcctcctcctcttcctgtgcgtagatatcgcagtcaggctccatcagcgccttccttaagtcggctatgacatccgttacatttgaatagcggcgctccggtcgcttctgggtgcatttgaggatgatctgttccagggcatgggacacctcgggcacatatacccttgggggcgtcaccggttcctccagatgggccaatgccacggtaatcgtgttgtcgccttcaaacgggacctttcccgtcaccatctcatacatggtaatgccaaaggagtaaatatcgctgcgctcatcgcagtagccgcccttggcctgttccggggatatataatggaccgatccgacggcagtggcgttcatggtctgggtggaaacggccctggcaatcccgaaatccgccaccttaaccttgccgtccctggatatgatcatattctggggcttgatatcccggtgtatgatatgctgctcatgggcagccccgattccctgggcaacctggatggcaatgccgatggcttccttactctccagatgtcccttcttctcaatgtaattcttaagggtaatgccctcaatcagctccatgacaatatagtgcagcacatcctcatccacaacgtcataaacactgacaatattaggatgggacaggcgtgccgctgcctgggcctccatcttaaacttgctgacaaaattctcgtcaaaggcaaattcttcctttaagaccttgatggcaaccagacggtttaatgtatggcactgggccttatacacaacagacatcccgcctgaaccgatgcgctccaatatctcgtacctgttctgcaggtatgttccggggttcagcataagccatcctcccttcccagcggattcacaagcaccaccgcaatattatcaataccgccctggcggttggcctcctgaatcaggcgcgatgccttttccttaaggctgccctctcctgttatgatcctgcgtatggattcatcatccaccatgttgctcagtccgtccgaacagagaaggatgtaatccccctcttccaggtccacctcaaagaaatccggctccacatccctgccgatgcccatggcccttgtaatgatgttcttgcggctgttgtaatccgcgctgccccggcgcatctgccccatggcaaccatttcctccacataggagtggtccttcgtgacctgtcggatggttttgttatgtatcaggtacaggcggctgtcccccacattggcaacatagagcaggttatcctccaccacccctgccaccagggtgcagcccatgcctttcagttcttccctgaggagggattcctcatacagctgttcattcacgattcctatccctgtcttcagctgcatcacaggggagccttttccttccctgttaatatagattaccaggttctcaaccgcaaaccgggaagcatagtccccggcctggtggcctcccatcccgtccgccaccaaaaacaggttgggcagggagccaaccctctccggcgacgagtagatataatcctgattcatggatctgacctggcctatgtctgtcaacgcatatgcttccatgcttactccgcccccttttccatatagctctttcgcagctggccgcaggctccgcctatatcccggcccatttctcttctgattgtaacatttataccgtttttttcaagcaggtccttaaaatctgcaatggccttcctgcctgactgcacgtaatcccgttccttgatgggattcaccgggatcaggttcacatggccatgctggtccttaatcaggcggctcagcgccctggcctcatccagattgtcattgaccccctggaccaggctgtattcaaaggtaagcctgcgccctgtcttctcataatagtaatggcaggcctccagcacatcctttaacttataacggttggcaatgggcatcagcgtcttgcgcacctcatcattgggggcgtggagggacagtgcaagggtgacggccagaccttcctgggcgaactgccgtatgcccggcacaatgccgcaggtggagacggtcaggttcctctggctgatattaagccctttttcgtgggaaatcaggcgcaggaaacggattacattgtcgtagttgtcaaagggttctcctgaacccatcaccaccacattggaaacccgctggcctgtgtgggcctgtatccggtaaatctggtccagcatttccgaaggcctcagattccgctccagcccatccagggtggatgcgcagaaacggcagcccatcctgcaccccacctgggaagagatgcatacggaattcccatgatgatactgcatccacacactttctatgatattgccgtcctccaggcaaaagagatacttcctggtcccgtcaacctgggatatacgttcctccgtgatggaaaggcatgtaaggctgtaattgtccttcagtttctgcctcagttccttggacaggcttgacatgccgtcaaagcttccagccagcttcacatgtatccagtcgtaaatctgttttgccctgaagggtttctcccccagggccgccatctcctctgtcacttcttccagtgtcatggattttatatccttacggcctttgttatccgtcaaatccaacatagcataactcctgtttctttcattatcatccatctgtcccggacccatacacggttcagcccgcaggaaccacggttctcagacgcgcctgaacacactgatgaaaaagccgtcaaaggggtggattccaggaaggaactgtatccgtccatccttaagggatggttcatcaaaatccgcccccagcctgccggataagtccactggctcaagcgggaaattttctgacagccacatggcattcccttcattttccatagggtcgatggtgcaggtgctgtacaccagggttcctccgggcttcacatactgccataccacggagaggatatcccgctgaagcctggaaagctccctcatcttatctatggtcatattgtacttgatgtccggctttttgccgatgatcccaagtccggaacagggcaggtccgcaatcacgatgtccgccttttccctggcatcctcatcaggcacaagggcatcccagaccaccgccttgatattggcagcgccggaacgggccacgttttcctcaatcagggctgtcttctggtaacttaaatccctcgcctccaccattcccgttcccttcatcttatctgccaggtgcaggcttttgcctccgggggcagcgcatacatcgatgatgtaatccccctccttcgggtctgccagttcccccacaaaggcggaggtggcatcctgcacctggatccatccgttttggaagcattccagtccttccatataatcatagcctgaaattgccagcacggagggcagacagtcaagttccttcaccattaccccctgggaatccagggaattaaggattgcctcccttaaagccctgctgaggttgcagcgcacccacgtgggcctgtcttcaagaaaagaggcggcaatcatctccgcctttgcgctgccatattctttttcccacatatcgtacatccactggggaatgctgtaggccagggagggggaatcaaacaccagggaagccttttccctggatatggtccttaacaccccgttcacaaaacccttaagcccggtgaaacggcgtttcaccgccagcttcacggcttcgttgcagaccgcggaatccggcaccctgtccatgtataaaatctgatacacgctcatccgcagaaggttgcggataagcggtttcatcttgtctgtctttgtctttgaatacttattaataatatagtcaatctgcaggagatattccagggttccttccgtcacccgggtgatgaacgccctgtccgacttgtccaggtactggtacttctgaagggcctggttcagtaccagatggacaaaactgcccttatccagcacttccgacagtatatccagcacaatcccacggttttccattcccctgtccggattcccagccatcagtccctccttctgttgaaaatcatcagcaggcgcagaagctggaggatggaggccgctgccgccgccacataggtaagggccgctgcattcagcacgcttctggtctggcccacttcctgtcctgccaggattcccgtggaatcaagaagggtaaccgccctgtggcttgcgttatattccacaggcagggtcaccagctggaacaggaccgccagtgaaaacagtacgatacccgccatggcaaggccggaaccgccgcttccaaggagcaggcctatgaggatcaggggccatgccagctgggaaccaagattggcggcaggcaccagggctgcgcggatccttaagggtgaatagtccgttgcgtcctgcatggcgtgaccgcactcatgggcagccacaccgatggcggcaatggacgtggagccatataccgcgtctgacaggttgactgtcttagacctggggtcataatggtcggtcaggttccccggcacgcgtcgtatggtcacatcatagatgccctgggaattcagcagccgcttggccgcctcggcccccgtcatgccgcacatgctcctgacagccgaatagcgctggtatgtggcattcagtttggcggacgccatcatggatacgatgacgccaatcagtaccagtatataggttgaatcataaaatggataaaacatggttattcatcactctctttcattatgcaaagttactgttgtgtcctgttcacaaacacatccccggccggtatgggatatccgcgcaggaatgcctctatatccatgcgcttctttccttccatctggagttctttgatggaaagaaggccgtctcctgtcctgactgccaggcaatgcctgtcagacagagccacccctccgcagggcaggctgtttgcaggggcctcatccttaatgacatccgcggcccagattttgatggtctttccgttccacatggtgtaggcgcttggccacggattaaggccccgtatcaggcgttcgatggatacggcgtcctgattccagtcaatgtccccaagggacttggtcagcatcttcgcatagcaggtcccctcctctgtctggggcgtgcgcacggccgtaccctcctccagtttcctgagtgtggagagaatcaggcttccccctgccaggctcagcttgtcgtgaaggcttccccctgtctccttttcatcgatgggtatgaccaccttctccagcatgtcgccggtatccaggcccacatccatcatcatggtggttatgcctgtctctttctcgccgtcaatgacacaccactggatgggagccgcccccctgtactttggcagcagggatgcatggatgttgacgcagccatacctgggaagttccagcacggccttgggaaggatctggccaaaggcaatcacgacaaacgcatccgcctccagttcccgcagcacctctatgaacgcctggtcccttaccttcaccggctggtatacgggtatcttatattccagcgcctggaccttcacaggcgtcatctgcatctctttgcccctgccctttggtttgtccggctgggttaccacggcagccacatcatgtcctgcttccaccagcgccttaagcgtgggtacggaaaaatccggtgttcccataaatacaatacgcatgtccacactcctgttcctcaatcatatctgtaaaaccctgcaatatacgttcctactcagcaatctcttcctcaggctcagcgccggcgtccaccagctcaccttccaccagttccacatacatctggccttccagatgggcaacctcatggcagatggcccttgccagaagtccctcgccctccagctcaaaaggctccatgttctcatccagggccttaaccttcacgtagttaggacgtgtcacgataccggatttgcctggaaggcttaagcacccctcatatccggtctggctgccgtcctgagcgatgatctctgggttgatcagcacatactggttgccgtcgtccacatcaatggtcacaatctgcttcagcactccaacctgcggggcggccaggccgcagccattggcctcatacatggtttcaaacatatcttcaatcaattccatggtccgcccggtcatctccttcgcaggcttgcacttctttgttaaaatatcatctcccataatccttatctgtcgaactgccattttctaccaatctccttttgtcatgttaaatcatactgtattgtcaggccaaaacggccctcggcctccttaaggcggagttctgccattttcctaatctgtatcagtatatcataattttcatgctttatatataaaatttttctataaatatcattaactttgtaaacaggcgcattcacgggaccgattaacttaaggtccctgccgggtccattcctgtcctgtccggccttccatccttccacccatccggcggtgcggccggccgcctgttccaccacatcctccctgggacatgccatctggatggttaagagtcccacggccgggggatagccaaggaggcgcctgtaggccatctcctggccgtagaatgcctcgtaatcctgccttgcggctgcctggatacagtagtggtccggctggtaggtctggatgaccacattgccctccagttcccctctcccggccctgcccgcggcctgggtcagaagggcaaatgtctgctccccgcaccggtagtccgatgcgaaaagggaaaggtccgccgctaaggcgcccaccagggtgaccttggggaaatcatgccccttcacaatcatctgggtcccgataaggatatccgcctccccccttgcaaaggcggatagtatctcctgatggcctcccttcctggacgtggtgtccaggtccatccgcaggatccctgcatccgggaacagcccggccgccatggcttcaatcttctgggtccctgtcccgaagggggcgatataccgggagctgcaggaaggacatacctttggctgttccatggagtagccgcagtaatggcacatcatgcggccgttcctgtgaagggtcagtgtcacatcacagtgggggcatttgatggcctccccgcaggaacggcaggatacgaagttcgcatatcccctgcggttgatgaagagcatgatctgttccttttttgcaagcctgtcctccatcagttcctgaaggcggcggctgaagatggaacggttgcctgccctcagttcctcccgcaggtccacgatttccaccttggcaaggctggcatctgccttcgccctctccttcatggtaaacaggccgtattcccccctcagcgcctttgtataggactccagggacggggtggccgaaccgaggatcagggacgcatggttcgcctccgcccgcacggcggcagcctccctggcgtcataccgcggggaaagttcgcttttgtaggcattttcatgctcctcatctataatgatgaggccaaggtttgaaaacggggcaaagagggcggaccggggaccaatcatgatatcaatatccccggtcctcgccctttcatactggtcatagcgttccccggcggacatcctggaattcatcacggacacccggttgccgaaacgtgtgtaaaaccgcatcacggtctgccatgtaagggatatctcaggaatcaggacaatcacctggcgccccgcctggagcacatgggcaatcagctccatgtagacctccgtcttgccgctgcccgtgattccatggatcagataggtccttcggattccctccccatagtcacggagaatggaatctgcaatctcctgctgggcctggttcagggccgggaaggtgccagggttcccagcggtgcctccgccagcaagggtgttcccttcccggggcatgccggccagccgctgcatctccagcagcggattccggtaccgctccaccacctccaccttaaggacgccgccctcctccagcggcttaaccactgctgccgtcaggcttaaacggttcatggcttcctcatacggaatcaccggcgccgagagaaaggcttccagaagccggagccttgccttatggttcttcctcctggcctcctccacggcccgtagcagcccctcctggtccagaagacacttcaactgccgctttggcgcctcctttaccttctgcttcactggaagcactgtctttaatgcctggttcatggtggatccataccgctccttcatccaccatgcaagccaaataagctgggactctgcagtcacgcttccctgcacaatcccagccacatcttttatcttattctcgtctatctccgcctggtcagtcagccccaccacataacctttgcgctgccggttgccctgaccgaaggggatatagacctgctgccccgcatgaatgctcccggacaggtgttccggtatcctgtactggaatgtcctgtccacgctttcatgggaaatatctatgataatattggcatattcctgccccacctgcgtcacctgtcaatctgaatccattataagttcctgactattatacatgacatcagctaaaaatgcaaattacgggggaatatacatcaggccagacacttttccagcacgtcaaaaagccgttcatagtcaatgggtttggcaacatggtcattcattccggcggccagcgctttggcaatatcctctgcaaacgcattggctgtcagggcaatcaccgggatgtccgccgcctgcgggtgggtgctttccctgattttccgggccgccgtatacccgtccatcacaggcatctgcaggtccattaagatggcctggtaatacccgtcccccgatgcctggaatgcgtttaatgcctcctgtccgttgaaggcgccttccgtactgattcctgcctccccaaggatggtcctgacaatctccatgttgagttcattgtcctccgccaccagcaccctgatggtcctgccggaaaatgcatccctgcgcctgcccacgtccacgattttcccggacgcttcctcttccttctgttcttcttcatccagtttcaggctcagcgtcacggtaaaacggcttcccctgccaggttcgctctccacctggatgctgccctgcatggcgtttatgatgccctgggtaatgggcatgccaagccccgtgccctgaatgtgtgtttccctcaccttttcctcccggagaaagggcacgaaaatatacttcctgaactcttctgtcatgccgatcccgctgtcttccacgatgaacacgaaattgccgaagccggcaaccctctgggccacttcttttacggtcagtttcacggtcccgttcccaggcgtatatttcacggaattggacatgaggtttaaaagtacctggcgcaggcgcccgctgtcccctatgaggcggcggtgcttaaggtctgccgtatccaccttcagggaatggcctctttcctccgccgatggacggatgatggtaaccacctcatctaccagcttatccatgcagaaaggcgcgtccataagctgcatcttccccttttcaatccttgacatgtcaaggacatcatcaatgagggccagcagatggctgctggacatattgattttctccaggcagtcctccacccgctccggctcatggctgtgggacatggcaatggctgtcattcctatgattgcgttcatgggggtgcggatatcatgggacatctgggccaggaaactgctctttgcctcgctggcctccttggccgtctcataggcggtcatcagcgccttcctgttttcctcttcctgctgcatctcatttatcttctgctggtggatgttcatattggcaaataccacctttgacacactgccgtccttcatctgggccacactgaaccgggagcgcacccactggacacggtccgggtactggcgcctgaagtcaatgtcatacacgggccgttcctcggacaggatctgctttaagaatccgggactccctgcccggcgcatcttctcctggtcctggggacatacatgttcccggatgaacttttcataatataccttcaggctccccttgggaaatgcccctgtcttctctatgtaatcctcctgccatacagcctcctccacgtcattgtccaggtcaaacagatagatggaataatagcactggcacaggttggaaagcacattgtccctgagccgggccttctccctgagcatgatggtatcggtgatgttctggtgatatcccctgaggcatatcccatcttcctggctttcatcccggacgcccccgcagcgcacatagatggtcccccacaggggatgttcccatggatactggacttccgcccgcttattgcggatcatctcatccacccctgtctctatcatgggataaaaatcatggtcaatccggtcataccatacccggtagcattcctccggggacggcatcccatccaggccaagaagctccatcatggccttatccccgtacatcctgggttccttcccctcctccagttcaatggtccataacccggtgcgggccatgcgcagaagttcctgcatactggccatatccataaaatgctcctgcatacacacctgcctcctcctatgtttattatcaatcagaccgatattgcccgtttttcaaatcccttgaacctcagtgagaacacaactgccctgaaaatccagtctatgaacatcccataccagattcccatcaccccaagcttaaatatgtacacgaacaggtatgcgaacccgatgcggaaagcccacatggaaaatacggacacggccatggtaaacctggcatccagggacgccctcagggtatggggaatggtaaatgccagaggccatacaagcatggcgatgctgtgggccgtaatcaggtcccgggacagccgggacgcctgccccgacagctggtaaatccccaccagttcccctgaaaacagcaccatggaggagctgagcaccagcaggatggcgtaattcacccctatgagggacttggcataatgctttgcctcagagagccttcctgcccccacgcactgtcccacaatggtgataaggcccagcccgatggcggttccgggcaggtacaggatggtgaccaggttgctggcaaccgcatagcctgcaatggaggcagtgcccagggaggacacaaggctctgcaggaatatcttgccgaactggaacataccgctctccagcccgcccggtatgccgatggaaaggatgttcttaatcatgcccatatccggcaccagtgacttcatgctgttcaggcggatggaattatggcggttctgtatgaggacaaacatcatggccgccgcaatgatgcggctgaacagggtgggataggcaacccctgccacccccatcttaaggccgaacacgcagatggcattgcccacgatattgatgatgttcatcaccagggatgtcatcatggacaccttggaattacccatggaacggaacagggccgcacatgcgttatacagcccgataaagggatatgacagcgccgttatccagaaataggtctgtgcattgtccatcacggacagttccaccttgccgaatatggcgcccaggagacggcggttgcctatgattgcaataagggtcactatcaaggacagggtcagggtaacgctgaccagctgtcccgccgccttacgggcgtccctgggctgttcctttccaagatactgggcggaaatcaccgcgcctcccgttgccagggcgcccatgatctgtatgatcaggacgctgatggagtccaccagggataccccggacacggcggcctcgcccacggccgccaccatcaccacgtccaccataccaaccagcaccgccatgatctgttccacaatcaggggggccagcagttttatcagttgttttttggaaaacatattacgcctttcttatactatctcataacatccgccctcccctgccctgatacaggcagagtaaaagtgtgcggctgcctccgtaagatagcatgtatcctttatgccggccgtctcatagggtgaatgcatggacagctggggaaggccgatgtccaccgtgttcagggacacatgggcattgcttatattgccaagggtagagcctcccggcatgtccgaacggttggcaaaggtctggaagggcaccccggccctttggcacagggctttgaacatggctgcggacaccgcgtccgtggtgtacttctggttggcattgtacttgatcacaatcccctggttcatataaggacggttggtggggtctgcccggtccggcaggtttggatggaccgcatgggcattatccgccgatatcatgaaactggatgccagcgccatcaggtatgcctcctcatccctgccaagcccggtgttgatccgcctcagggtatcctcaaggaatgtggaatccgctccctgcttggtcccgctgcccacttcctcattgtcgaacacggcatggaccgcaatcccctccgcgggttcaccctccaggaatcccttaagggacgcaaatgcgcactgcaggtcgtcaatccgcccgcaggagaagaactcgccttcagccccccatatggttcccggcatcctgctgtacaggaacaggtcgtggcccaggatgtcctcctcatggacgcctgcagcttcagccacaagcttcatgaacgtccccttggagccgtggccgccaaacaggggaatcatatccacctgtgggttatacttgtatccatcattgacctgacggttaaaatggatggccaggttgggaatcatcaaaaggtcacggtccaccttcacaagctttgataccagacagttccctgtcttcaccaccagacgccctgccacggacaggggccggtcaaaccacggcgcgcacagcatgccgccatacttttccacattcagcctgatataatggccttcggattccatctccgggttttccttaatcttaaaggacggggagtcactgtggctggccatgatctggtagcccgaacaggttccggccggtatcctgaacgatatgatagatgactggttcctggtcacgaagtaggatcccttctttttcaattcccacttctcaccttcatgaagctctgtaaaccctgcttccctgaggattcctgctatatttgccactgcatggaagctggtggggctgtcctccaggaaacgtatcagtcctttggtcagctggatgcattccgccttctctatactcatcatgtatctcctttgtcaatcatttcctttttataccatctactgtaccacaaaccggtccatcaggcaatagagccgtttaattctccctggcagccagccagggcaggatgaacccaagccccaccagcacaaatggggttacgatgttgagcaccagctggaacaggtcatcggaatagatacctgtgatacaggcaaatgccgtaaagccgaaacaccagattcccaccagggtaccggctgtcctgccctttaagaaccggtactgggcgtggaaggcatcccccgccctcttaagcgcgatataggccacgaatacccacaggtaacgaaggggcatgcagaccgagttgacctttaccagccagcgcaccagcacgtccacattccggatgccgaaggcaggcacgatgatcaggacgcagacaatgagcatcaccagcctgtgtccgtttacataggtgccgtgttcatttttctcaaacatcttcctgggtatgaagcgcgtatccgcgctgtcaaggagcatgcgcaggggggcgtccacggacagcaccatgacggaaaactggccgatcaggttggtgagggcgtatacaatcacaaagaaattccccatatgatagtattccccaagcctctggaaggcgtaataggcgccgtttgtcatcaggtccgccgggatatggtctgaatcaaacatcatcccaagggcaatggtgccaagtatggcggtcactgccaccataagggccagggccgccattcccttggagaaatccctggacgggtccttcatcttgttgacatagggggatattttctcgcatccccccaccgcgaagaccaggatggaaagtcccatgaagaagcttaagtcaaagctggggatgaaggtcctccatgaccagtcaatcgacatgaaggttcctcctgtcaataccggggcagccaccatcattgcaatgaacagcatggacatgatgaacatggtggaaccggccagggcggacaggcgcttaagcacgcccatgcccttgctggataggtacatggcaaacaggaatatgaccagacagattaactgcatgaccgtggtatccatactgctggccctcttgtcctggaacagcgcccagctggccgcaatcaccgtggaattgggcttctgggaaatatatggcatgtgcaccacccaataggtccagccagcatagtatgccatcctgggacctatggtttcctggatccaggaactgacgcccccgcccgcatccttgaaggtggagccaagctcgcctaccatcagggcatacggcacaaaatagatggcaaatatcaggatccaggacacaatcgccctgaggcccccgtattccgaaaacccgttgatgacattcccaaagccccagaccgtggaaaatgccatgaatgcaagggtatgccataaaatctttttatccttgtccctctgtcccatataagtagttctccttttccggttaaattgtctccctgaaggattattcttaccagaaatatgaaagatatgagccggatacctgttttttcattctttggggaccggctgaaaaaggcagccccggaccggtgtcatgtgacgccggcctgaagctgcctttaccagacctaaaaaaccatcttctgtccaatccccatttccagcgcccgctcatagacggtcagggcgcagttcacatcgtgggcccccatgcccatatgcgtggaaactatgatttcatcctcccgttcccggccaggtacctttccggtgagaagttccgtcatatcgccggatacgtccccttctttcagcaatccgcctggattcagccgtggtgaccgtaaaatatgggcgtccggcctgcggtatcccaggtaccatttgtctgccctttttccaatctgcgggtccaggtcccggaatccctcgattccaatcacggttgcgccgggctttagcatatcccaggtaacaaggggtgtctgtgcgccggatgccataaggattaaattgcttccggttactgcctttaaagggctgtcacagggtatcacctccaccctgtccttcagttcctcccttacagcctctattggcccggtactccggctgaagatacggacctgcctgatacaggggaactgggtaagcatccccctgatgccggacctggcctgggcaccgcatccgcagaccgagaggacctttggccctggcaggcacaggtgcctggcctgtaccacgccatggcctccggccgtgcgcatggcagtgatgttcatggcccctacaagggctatgggggacccgctttttgtatcacttaagataaccagggttccgtgacagaatggatagccgggcagcgggtccgcatacgtgctgatccatttaacccctgccgcgtttctgtagtggaggatggcaggcatggaatgaaaattgttcattttcgcttcatccacatacatgagcgccatatcccccaccgtgatgtcccccaggccgatatggaggaaggtgtcctctgctgctgcaatcgcatcagccggggtcagcagggaacacacgtcttcctcatttaaaaatagcatatgattcattttcctacccccgcttcctacatctgtaattaacatcaggtccgcttccttatggattggatcagtaggttgcatgccttgtcacttccgctgtcccggtactcctcctcagtcacacaggtcaacgcctcaaaggaacaggcccttacacaggccggctgcagcccatgcttcacccgctcattgcagccgtcgcacttgaccattttcccatccgtgacacggtatctgggggcgccgaaggggcaggccatggcgcagcttttacagccgatgcagttggtgttatcataaacagtaaaacctgtttccgggtccttgcccaggcatcctgccggacaggcatccacacagggagcatccgtacagtgcatgcaggccgcggacaggtaggcgcaggtattgctgccgtccgcctcctctatctcctggtcaaaggttttacggtaacaggtatcgcctgccgtcaggtcaatatcattctggtccatgcagcccatcatacaggcagagcaggcacagcacttatccggattaaatacaaaaacatgtttcattattcaacctcctggcatttgcggatattacagcgcattcccttgaatccgggaaaaccggaatagggatccacatgattgcgtcctatcagttcgtttacattggcctccgtataaccgtggagcgtcaggatgacacccggctttatctttcccgtgaccttggccttcatgaaaatctcgccgtaaggacttgataattcaaccctgtccccttccctgattcccagcctcctggcatcctccctgtggatctcacaggtggggtcgggccggatactgcgcagccacggggtctcatgtgccctggaatggatggcatgggccagccttgcgccggtgcatagatagaatggatatttctcctttgtcccagggtcattctggtcttccagtgaatcccggtaatccggcagcggattcaggccaaaggcagggtctatggatgcaatggcagtggaataaaactcaaacttccctgtggcggtcttaaatccattctccaggcacgttcccggcttcacaggccacttggcggcagggaccttcaccggcaggctgcttgcctttaaatccgcaaccgtcagtccgcagccctcaatcatccagtccgccgacgcctcataaccggccttcaggtacgggtcatccaggtccatgatgcgggtcaggccgcacaggatatccacatcggatttagactcataaaggggcgggattaccggttttgtaaaggtcaggtaaccgccctgatacgcctttaattcccctctctcaaccgaggagcaggccggcaggacaatatccgcatacttggctgtcatggtcatgaacatgtccgtgtccacaaagaaatccagcttatccttcatggcagagagaagcttatctgtctcaggaaacattttggcgttcattcccagcgcaaaaatggcctttaccggatagggtgtgccctcctccagctggcggagcaggtccattgcctggaattcatcaaactgggcattccacagggggaaccgccccgccccgatacgctccccgtccttgggataacggtcggacctgaactcatgctccctgaccttaaagccggcgggcttatgcaggtaggtcggcggattggggacattgccgcccgccctgtcaaaattgccggtaagggcggacaggcacaggatggccctgtgggagttaaacccgttaatgtgatggaccagggcggaggcggaaaagttggtacaggccggcccgtttgtggcatagagctttgccgcctcataaatcagatcgggttcaagacctgtgatgccgcttaccctgtccaggggatactggtccaccatttccttatactggtcaaaaccgtatgtatatttttcaatgtattcccggtccgcccagccattgtcaataatcagctttgccatccctaaggccagcgccccgtcggtacccggattgattttcaggaagatatcagccaggttcctggatgccggggtatcccgtatgtcgatgatgatgaccttccctcctctctccctcagtttctgcacgcctgccacggagagatgggaggaataatagccatcgtaattccagcctaaaaatgtattggcatggcccatgtcaggtcctgcgccgcatcctgcggtcaccttatccgcaattacctttgaggcgctgcaggtactgtcatccgtgccaaaattcacgcttccgaacacatgggcaaagcggtggaaaatagggcggtaccacttgcagtaaccgctgaagaaggccacggaatgaggggaataggtttccttgacctgattcagcttttctgcaataatccggtaagcctcatcccagctgatcggttcgaacctgcctccccccctttcccctatgcgctttaagggcgtcctgatgcggtcctccctgtaaatgtagtttctaagcgcggaacctttcgtgcaaagcctgccatggttatagggatgctccggcgtaccctccacccggatgatttccccgtccttcacatagcagtccacaccgcagtgatggcccggactgcagattgcgcacagggaatgtcttatttcaattccggtatcttcacccggaatctttgcctttatttttttctcaagttcagtcaacggattttcctcctaaaaattctataaagcctgccggaaagcccttatccatcagataacagatgctctggacatctagaccggcatccgggcttttcagtgatttgatgaaaatgctttttaacaggccattgctgtccgaagagttaatgacattgatacactggatcctgcccttgtttttcgtcccgcggatataatatgtttcatcctcatattcataaaccaggtcctccgggccgcaggcgctgatatccccgatgctgataaaatcatagtccagataatgggccaggttcacaagcacattggcgtcaaattccatcggcacaccagccatgttcgccccggctgtccgtccctgtttgacggcattcagccatacccctatgttcctggttttcccgctttgggtgtcaatggcctcgcagcagtccccggccgcataaatcccctcataattggtccgcatcctggaatccaccacaattgcccgtcccattgcgagtccgctgtcccgtacaaatgcagtattggtccgcacgcccacgcagaccgcaatcaggtcggccgtaaaccgttttccgctttccatgacggctgacaggcgtccatcctcctcctgctcaatggccgagagcatctggccgcaggatacggccacccccttttgttccaggtctgcctggaccctttgggcggtttcctcaaatgcagcggtataaaacatccagggcgccccgtccaccagggtgcagggaatgttcctggacctcaggtcctccaccaccttgattcccacccaggatgcgcctatcaccacacagctgcgcacctttcccgagtccagcttctgcttaagatccacggcgtcctccggggtcctcatcttaaatacgccgggcatctggattccggggacaggaggcatgacggcagacgccccggtgctgattaatatttgatcataacccttccggctgccgtctgaaagtattatcttccgctcaccgggaaccagtcctgccaccggcgtccggcagttcacattcaaatcaagggttcttgcaatctcctcaagggtcccgaagggaaacatcccctcataggaaagggagtccttcacataataggttgtgagcatgggattgcacggccctgtatccgtatccgaatacacatcaatgacagcctgcggatccagtctgcgtatttccctggcagcgctgtaaccagcgccgccaaaaccgataatggctattcttttcataaagtcctccgcttaggcaagcattccgctgacagaagcaatatcgtccacatgttcaatattgcagattgtctcaatgacctgctccagcttttctccctgcagcacaggggatgcctggatacggaacctgcttacaaactcgccgcgttccatcatattggccggatggcccggatggcagtccatggagccggtaaaggtccgtccgtcctttaacgttaccgtgattgtcttcatgggataagaaccgttccggaactgcttaaagcccgtcataggcgaatcctcgggagaggttcccggcttcaccctcttagccagtgcaatgacctccctgtccttcatcatctccggcgtataccagtaggcgccgggattgggatgcagcagcatggtggcgattacatagggggcggagaactgggcatgggttacggaggtaaagccttcatccggagcccacatgcggttgcggataggcgggtccaggatgatttcctcaatgtcatccggtccgaatccgtgttcctttgccatgccgttcaccagttccaccggggtctgcacccacatattggcgggccagtgcttaagcagggtatccatgatcagataccgctcccccagctccctggtaagccaggacaggtctgcttccccggatctgattgtggtatcggctgaaccgttggagccgtcatccccgcagatgacgccggtgtagcatctgggctcatccagggcatccctctggttatggattcctttctccacggacttggcaatcaggaagccgtccctggcccggtaaccgtgctcatagtgatagaaatccgacatggtagttgcatggtaggcaaccggaagggtgctgcactcacagcccattccgatggcctggttgatcttcctggcatccagtccgtaaatcttgacaaccggcaggatgcaggcaaatatctgccagctggtcaatccccagccctttgtcttccaccgttcgtccgatggctggaccgccatggcaatgcgctggtatacctcgtacccggccacgatggccgtaatcaggtccttgccgcttttatgcttttcctctgccgccagccatgcgcagggaataacgcctgccgccggatgaccggtccaggaacagtcctcccagtccagggcatcgctgatggtacccaggacaagggccgcattgaccgcagccattttcccatccatgccccagaccgttgtagggccgccggggccgccgttggcctccctggccattttccctgctttttctgcaatgggggttcccttggcagccagggccgcgccaatggtctgaagcaggatcatcttggcccgctccaccacctccggcgggatgtcctcataggataattgttccgcatactccgacagttcctgggtatatgtagttggagtaaggaaatcattgtctttatataaccggttataccgcatacttgtacctcctcgttatgagcactcagcgcttgtcttttaggcgcttacggcgcctgtttttgcgctgatgtgcaatacattccactgatatggagccgggtcttttaccagcttcccgcagtggctgaatgataaaaaatggaacgccggattaatggaagaaaccgggaagcacggacgcatccgggcattcctccaaatgacagatgcactcgatggtgccttctgttttctccttggacaggatattttttgtctccaggcggaaacgttccttaaattcatcccttgtcagcatgtagcgcgggtggcccggatgggtgaaggcactctccgtatactcggtcccatcctttaaacggacaatcatgaacttctccggatgcttaccgtcaatcaggtccttaatgaatttcatccccgacattttcacaaatccatctgcctttaccttgttcatcagggcgatgatccgcgcatccttcatggtttcgggctgataccacagcgctcccggctccggatgatacatggcgcaggccgtcacatacggaatggagaactgggcctgtgtcagggactcatatcctgtctcactgtaccagtggcggaaggcaacggacgggcgtatgatgatttcgtccacctcatccgggttaaaacaatatctggtcaccagacgggaagccagctccgcataggtctggacaaatacattggcaggccagtgctttaccagaagcatatccatcatcatccagtgggtccccagttcctttgtgagccattccggttcctgatatccgcagtgggccaggtatgcggtggggtcgtcaaaggcgtcctccatgttctcgataccatttaaggcggtcttaatcatggtcacgcagttctccatgcggtagccgtacaggtaattcagggaatccgacatggtgatttcgtggacattggccggtatgatggcacaggcggttcccacgccaaaggcctggttcatcttctcttcaggcaggtccaggagcttcatcagcaccggcaggatcccaaagatattgtagctggcaatgctgctcctccccgccagcgccaccctctggtacacctcgtatccagccaccacggcggtcaggagttccttcccgctccggtgcagcacctccgaggcaatcacggctgccgggatcacacctgcggacggatgccctgtcacggaacaatcctcccagtccagggcgtcccccattgtgcctgccgtaaaagcagcagcctcccagcttaccttcttaccgtccgcccaaagggtggcgcagccctcttcccccgggctcatttccttggagatttccattgcatccctgacctgctttagctgtgcgctgcacaggctgacgccgcaggtctgcatcaccatcattttcgcctgctcaatgactgcaggcggaatatcctcatacttcagtgtctttataaaatgacacagctgtttcgtcatatccgttgttatttcatgaacattaaaacccattttccatcctccttgttacctaaattgtgaacagcctgcccagcccgtcaatcttatcatttaccctgcagtggcgcaggcaggaccacaggctggcctgatggctggtaatgaccggcatcccaagatcctcctccaggatttctaccagctccatggtggccagccccatacagcttaagaaaaacacctcggccccttctgttttcagtttcttggcctggcggtataaaaaggccttgcccggatgggagtattcacccacccggttgaatcccactccggtaatggaggtgaccgtgattccattgtcctccaggaactttttctcagcctggttggtttcttccggataaggggtcatgaccacggtcctgttaagccccagggccctaaacgcctctaacaccgccgtgctggtggtcagccccggccatccgcaggccctctcaatccgttcaatacattccttatcgaatccataacctttgatgcagctgcctgaggtacagccgaaaagcaccacatcatgacgctttttcttatacatcctggcggcttcctccagctggtccgacagataaatcaacccctccggcgtcgggccggggaaggaaagccgggtactgtcaaaggagaccccttccggggcatatttattaaatgcatattccacctgatcgtccaagggggcgatcacaccgattcttgcccgtaaactatacatgtcccatccctccttcaaagcgtaaacagtctgcccattttaggaagctttgcccctacccggcagtggcgcagcgcgctccataaagttgcctgatgactggtgaccacgggtatcttaagggcagtctccagatcatcgatgatttccatggtagtcaggcccatacagcttaagaaaaaggtatctgccccctttaaatccatgttgatggcattgcggtagaggaaatattcatccgcctcctcaagcttatgtccgtcccggcgtatagagcttacgtccatgccgatgatgcttgtaacctcatatccattgtcctctaaaaacttcttttccgcctcattggttgcctccggataaggggttaatacagccgccttctttgttcccagcgcctgaaaagcctccaataccgcggtgctggtggtaaggcccggtatattgcaggcattttctatcctgcggatgcattccttatcccagttggcgcccttgatgcagctgccggatgtgcagccgaacaccaccaggtccacatcatatcctttatacctggcagccgtctcctccagctggtccgttaagatcataagtccttccggggtcggccccgggaagttgattttcatcgatgcaaaggaaactccttccggtgcataaatgtgaaacgcatgctcggcattttcactcattggggtaatcagcccgattttcgctctccaaccatacataattcgcttctcccattcctttcctgtagtcatgcccctgaccctgtctgctcctgccatcattctagcaacccttggcatcttttgccatccgatatttttggtatccattagcaaagaaacatgcaggcagattctttggaatgtcttttatttttccgcacagatgatataatagccccaacctgctccttgcaacattgtccttgcaccctgccccgggcgccggacaaattaaccggcagattaatgcttcatctagtgatacaaagaataaggagaagattggtatgaagaaaggttattcacctatgatgtatgtgcacatcatcatcacgctgtttcttatgttcggctttggtttcattccgccctttgccacccttacccccatgggtatgaggctgttaggcacgttcctgggcgttatttacggatattccacctgcgagatcatctggccctcccttttcgccttcatcgcttacggcttaagcgggttcccgggcagcatgaacgcgggtatatccgccaccatgggaagttctaccgtgttccagatcatcacccagtactttaccgcaggggccattgtaatatatggttttgggaaatggttcatccgctggtccctgtcccagaaggcatttaagggaaaaccgctgttttacacatggtgcttcatgttcatcttcatgtggtccgccattgtattgagccagatagccatggccctgctgctctacgccatctggacggatatcgctgattcctgcggctatgacaaggacagcacattccgctattacggctttggcggcatccttttgtccatggtcatgggcggagggatgattccctataagagctggatgctgggccttgcaacgacctgggccgatgttaccggggaaatcgtcaacctgggattcatgttccttctcaccgggctggtggggaccatcgtgatgacggcttacgtcatcctgggcgccaaacttttcaaggtggatttcagcatcatgaagggctttgacgtggaaaaaatgggtgaggacagtaagcatttaaggcccagggccaaacgcatcatcattgtttatgtcatcatcatgctgctatccatttttgccgggacctttaccaaaaacccggtttccaatttcgtcaacaataccctgaccgtgggcggtctgtactgcctgtgctccgccatcctgatggtccttcccagcggcgagggggacaaaaaggcagccattgtgtttaatgacatcaagcactctgacgcagcggtcagctggcccgtcatcatgatgtgcgcaatcaccatccccctggccactgccatgaccaacgaggcaaccgggatccttccctggcttacgggaatattcgaacccttatttgccggaaggggtccgctgtttatcttaatcttcaccatcatcgtgatgatgatccttaccaacatcgggtccaatattgccttcggaggggccatgattcccgtggtcagtccctttgtaatggccgcgggcatgaacccggtcatagcgggcgctgccctgatctggattgccaacatcgggattgtccttcccggcgcatccgccccggcctccattttccatgggcggagcgagataccggatgccgccatgcgtaccaaggtggtctgcttcggcgcgctgctcatccttataacaactaccgttgtattctccatcgcccagctgattgcgggatgaatgataaaatcgtgtaagaaagagaggaattcaaaatgatccagaatattactgtaatcggagccggttccaccggtcatgcggttgccgccatcatgtcgcagaggggctttcaggtaaccttccatgatgacgcgcgtttccagaaggagctggatgccgtaaaagaaatgggattcatccagctgcgcggcaaggtccacgggaccggcacgccggcaaaaatcacattggacccaggggaagccgttgaacatgcagaggccatcttcatccacgtcccctcggaccgccacgaggaaattgcacgccggattgccccttatgtcagggacggacagcacatcctcatcattccgggaaacctgggatcgttcattttcagggatgtgtttaaggaaatgggtgttactgcaaaggtcaccctgacggaaaaggaaggcaacttctgtccctgccgtctctccgcccccgccgaggtcacggtcggcatgccgttaaacttaaagggaaaggcagcctcccttcccgcctctgacacggaaaaggtgctgaaagcattagaaggcgtagtggaatacactgccaatgagaatgtatttgaaggcgtggtcaatgcaggcaatgtcatcaaccacatcgccagcaccgtcctgtccactcctgaaatcgaccgaaagggaaatcagttttccttattcaagtatgcattcaccccctccgtggtccgctgcatacggaaaatcagcgaggaaaggaagcaggtgattgaagccatgggcctgacggtccacggcaatcccaccgggatgattgacaaggtactggaccttgacaatcacccggaggttcatgtattctatgagtatatggacggccccaatgccgtagatcatcgttatctccatgaagactgcagctgcggaggcgcattcgtcctctccgctgcccagcgtctcggccttgacatgccggtgttgcgctcctttttaggcgtggccggtgcaatcaatgaccgggattatataaacggcggccgcacccttgggaatctggggtttgcagaggatatggggatggaggatatctacaaggaactctgatacatatcaggctgccgcatcaagccagtgccgcccggcgtatttacgccgggcggcaccatggcgtgttcctgcttatccatccttcttcggtgcatccacaaacaccatcatggcaggcagcgggacacggagcgtgcacgccttggcaggacattccagtacacaggaattacagtgccagcactcatcaggatagtgaaccactggataggctgcttccttttgctgatggccgaatgcatcaacagggcagattgtgacgcagttcatgcaaccattacatttacttttattgataataggtggcataatccatctctcctttcacttacgcatattgcggattccagtaacaagttttccatctatcttctgaaccgtcatcagctttccatcataagagggatccgtaaatgggtaatccgcacgtttatgcgcaccccgggtctcttttcgtgaacgcgaggattccatacacaatttcgctacctgcaccgtattcatagcctcaagacaccgaaggaactcatggttattttcacaatgcagggtcttaatcttctcctccagacggctaagatgtccaattcctactgtaaaaagtttctcactgcggacaccgcttccaagataatcccacatggtctgttggattgcaacaattgcttcctgccaggtaggggtggcggtaccgacttcattggaaaggatcctattgtaatacgccattgcctccgcaacgatatccatatcctctgccgcctctatttcacggttcctgcagtattctgccgcactgcgggctgcaatacgtccggtcgttgctgccggccctataccgaccatgccgttaccgcttgaaacaccggctgcatacaggcccttaacagtggtttcaccattggcatatgtatcgatgcccactccctttccaccgcctccgcctttcttggcattaaactcaaccatgtgttttctgaagtcaaaaccctcgtcctcaaggtgctggagggttgcaccgttgccctcatgaagcaaggcccatttcatatattcaatatcgtagtccgtaccctcagaacagttcataaatacaggatttcccttttcaaagttcatattgaacatctgcgggaagatatccgcggtaaaatcgccatatctgtaatcaggctttttaacaaaaggcccaagaggatttccgtctatatcggtataaaccccaacccatgtggctttgccgccccggttaaaatacttgcagccggatacaccgatgggcgcgacagccccgtccaggcagaccagccttgcacccgcccggtatgcagccgcagtactgacgccagtgcttgcaggacatccaatcatgttaaacatccagcccatggaacttgaaccgttcatcatcatggaacccgcagttgcaataagcacgctcttggcacggatgacctgtaccatcggctcctcttcattcagatcaatgcagatgccgccgcagacctcatcctgtttatttgtgatgacttcggtgagaggacaacggttcagaatcgtaacccctctctttaatgctgcttttgtgagcaacggtttctggttcaggccttcatacttaagataaatcccctgtacgcccggacggcagtgccctgtgaattcccagtcaccgtgagggcgcatcggaatgccgtaggactcccaggccttaacaacatcaaaactattgcgcataaatgccacgagataatccttgtccttaccgccctttgcttcctgggcatagacaagatggttcatgaagtcctgttctgaaccatgaatttccggaatgtagaccataaaatgatcattaccggtagcaccattaccgctgcgcctggtatttgccttttcagcgacaattaccttcaaaccagcttcagcagcatcaattgctgcctgcataccgccagcgccgccaccggcaatcagtaaatcacattccatcactttcttttgagcaatcataatttctcctttcttattgttatcacatgaacaagcggtcacggccgcaatgctgttactttagaagctggctgaacatggacatatcctctatcttttcaatattaagaataaaatccatcatcttttccgttgcctcccgtgacagcacatcctgcgtttccaggcggaacatctcacaaaactcttcttttgtaagcatattggcaggatgtcctttgtgtgcagacatggaatccacatagacccttccgtctttcgtacggatggttgcggtcttctttggatggcttcctccctgatagagattgaaagatgcaatcaatgtatgctcctggctgggaccacctttaatgcgccctgccagttcaatcagcttcggattcttcatcatatcatccgtataccagtttgctccaggtacaggattcagaagtgacgcagctaccacataaggcatgctgaactgcgcttcggtaagggatgtataaccatcttctttaaaacgcatgcggtactgggtgggagggtcaatcatgatttcctcaatatcatccacattgataccataatccctgaccatgttgcgtgtcaattccacaggggtctgcacccacatattagcaggccagtgttttaccaggatgtccatggtataataatcttttcccaggccacggtccaaccactcacggtgcacctccggggtatactgttcacagaaagcatatggtatatccagcccatcctccatgttatgtatgccagcctgtgcgcaaagcgctgctatacagccggaaatcgcggcagaaccctgctcgtatttatatccgtccgacatggttgcctgggaaatattacttccattttttgcaagggaaccggcaagactgacactcttgtttgtctgcgtttcatcgagaccaaggagtttgccagcagtaatgttagaagcaaaaatctgccagctgcaaatcgcccaccctttcatatggtcaaaatcaggaagcggctgtactgccatggcaatccggttgtagccttccagtcctgcaaccaatgccgcaaggtaatccttcccgctcttttttccagcctctgcaaatgcaatgcctgcggggaccgccccgcaaagaggatgccctgtccatgcacagtcctcccagtcaagtatgtcacatgcaacactattggcaaatgaagccagtgccggtgtgaccttcttgccattataccagatggttgcatccccgccctgaccgccgttcatattttctgcaatcatcgccgcatccccagccatctttatcttcgaagccgcaagggaaacccccaatgcatgcagggtcagcaattttgcgcgttccaggacctctgcaggtatgtcttcgtatctgaggttgacaaaataccctgccaaggtcttagtataatttgttgcaaaatccgtattcatatattttacctccaaatgttaaatcgttcattaagtatcagcaaataaacgtccaagtccgggaatacaggttcctatgccgcagtgccttaacgcaccatacaggcttgcctgattgctggtaatgaccggaatccccaaatcctgctccagcaaggaaatgatttccatggtgttaagacctgtacagctgatgaaaaggcactgtgcatcccctaaatccatctcacgtaccgcacggtatatctgactgggttcaatatctgccatatccccctttacacgcacgattccctgggatatatccggtaccccgaactggcgtatgggactgcagtccattccggcaattgacgtaacgtgtacgccattatcttccagaaacctcttttccatggcattggtttcatccggataaggtgtgatcacggctgtctttggcattcctaaacaatcaaatgcttcaaggaccgctgtgctggtagtgatggaaggaaccccgcttgcaagctccatgcggcggatacactccttatcaaagccataaccttttaccatgcttcctgatgtacatccaaaaaccaataactcatggcgctgttttttatacattcccgccgccgtttcaagttggtctgacaaatacaccagaccttctatggtaggaccaggaaaccataattttgttgaattaatggcaaccccctccggtgcatacagattgaaagctctttcaatgctttcccctataggacatatcaaaccaatccttgcgcgccatcctgacatgaaatcccctcctttttgacttgcaaattctttaacaataagctattcttaaaacagttcccatcattccggcatatgaccacatggagcatggattatgaagattgaattactgcaatatcttgttgttaccgcgcaatgtacatcgattaccgatgcagctgaccgtcttttccttcaccagaccactttaagttcagcaatcaagaatatagagaccactaccggtgttgaaatctttacccgcaataaaaacgggattgttcttacagatgccggcaaggaactcgtctcccttgcccaggaaatcatagacaaatgggagcagatcctgtcactttcgcttaaacaaccggaaaaccaaaattcactgctgcttacccccactatcatagccgaccagtattcgcttctttttctcagtgcataccggaagcttgcgccccaggggagcctgtccattgccacaatcctgcagaatgatttcatccctcagatgctgacagggaacttcaaaatgggtatcggattaactgctccggatgacatggttcatgtaaaagccttatttgtaaaaaacaacttccattttatccctttaggcatacatgaaacctatctgtatgtaaactcaatgtccaggtttgccgggagggaatccgtatccctttatgaactgtatggtgagaggctggcgatttccgaaaatggctaccataccttccatacgccggaacacgccaaggtcctggggaatccggttatccttgcaaatatacatcttgttcgcaaagccgttgaacaggaaaatatgattgccttttatattccctgtacaagccagaaaacagactggttctgcagcggtacctccatcaaaaagattaaacttcttgatggaccacccagctgcacgaaacatagttttctggttcataaacatggtaactgcctatccgaggcagaaaatgccctgcttgaaaaaatctcagacatcttcgaaaataattaaataatcttatctaatattggaaatacaatagcgccaacaacaaaataaaacagaatgaacaccgcactgtatcccatgatatccttaacgctgactttaagctggtccttactgccgaaaataagcgccgcggccgcagaaccaccaggagtcataagtccaaagcatgcagacatgatacagcagataccaaccacaaacttattagcaccagctgcatctgccacaggaaggacaatcggaagcagcatcatgccaatgcccgcattgctggcaatattggtcaggagtgtcgcgcagaccataaccaacagataaatcctaagggttgaactggaactgaaggtcggtccaagcacggaggtaagccacacagaaaagccagtgctctcacttatcagggcagaagacaatgggattgccgctgcgataatgaagaaggatccccagaatgcaccaggtgccatcgtttttttccagtcaagcatagggcgtccatctttatcgcgaagtagaataaggactgcaaccgcaacgctgaatacacctgccatggtaagggtctttgaaatcctacacaggatatttgtcgttgggaatatatatccggaaagaccaatgatgatggaggccagcatggccaggaagtaagcggtctgcctgctgttcagcctggtactcccttttgctaaggattcattgtccatatccttcataaaggatacatcgatttttgccagctttatgaatagaacacatgccaattccgttagggtgccgaatatgaatacaattgccagatatgtcatgaaattcagttccgaacccatcatctcgccaaacgcattccacatggcagtaagccatgttttaaagggaatgatcatatcaccgttcacgcaggtcaccaccacgaacaccgtcatacagcggaaatatttctcagacagatcctgatccagaacatttgcaaccccctcaataatcgcccagccaagcagaatcatgccaagcggattgctgacagcggaaatcattcttaaaataaacaggaaaatgaaactgaacagcagtggtctgccctgcatggccttccggctaagcgcccatctggctaccagttcacctgcgccactttgggcaattgcagaagcaagggtcagacacatcattacctgccagatggtactctgcccaatggcagccgtgattgcgtttccaacggttgtatactctgtaagccccagggctatgatgccaagtatgctgggccagacaattccgccaaccgtggaccataagatgaccatggatacaaaaatacagagaatctgcatacctgtctgtgttatttcagaagcaaagggaggtattatgattcctccaaaaaacatcaggaagagactcgccgcaactatcatgtaataagaaacgtttttgttcaaactcctgttacccattattctccctccatatacattcatgatcttcctggtacagccttgcgtaaggctgtactagctatctacccctcaaaaagacgatgattgatttctgttggatccatccctgcaaagccgagcttttccaaagtaataccctcccgtctataatcctttccatttacagccgatatgattgtaacagcagaggacatcaaaggcatcttcatgccaactgcatctgccatggataacagcagacaattgccggcatatgcgtcctctgtgtagtaacggtgtgcaaccccatcaggtcctgtggtcgtaagataaaatcccagcagttccggtttcggtgaatccacatagttaaggcatgcattcatcatttccatattgctgcgcccgctgaaaccaaatttcccaaacacggcatcccgctccttttcaaccgcttcaatcaacttcacaactgaagcagaaagaccatccctgtacagcctgaaatcagccgaccgctcaaccgcagctatattaacagtggaagcaatcagatggattgccacattcggagcatttaaagctatctctaaaacattcttttgaggaatgtcgggataacagacgcagtcataacactctttcaggctttccacaaaacgcctgctgtctttggcaggatatgcggcaacccctttcgccttttctgccacaggcatacagtaatatacaactgcatttccgcgataccttatggaagaatacgcccccattgtctccccgaccagaatatccttcccccccaggaaaggcttaaggaagattgagccgcagtttccattaaaaaagcatactgtctggccatcctttaaatgtggcgccatcagtccgcaaagtttcggatgacggtttgccaccgtagcgacaaatacaatgtccgcatcatccaaagccttccccatctccgtggtaagttcaggaagcgggacatcctgctgcttacagcatcctgctttatgtatgcagcccgctttcctcaaatcatctaaattgctgctgcattcaggttcttcaaaaaggattaccttatgaccacctaacaacatgtctgccgccagcgcgatacctgtcgctcccgcgccgataattccaatttttttcatgaacaacttcctttcctcaataagtagtacacctgccatcactccttttgatatggctttattatggaaacgactgctgcagtcaatcattttgcatatttttttatgatttacatattttttttggttatttttcacatctcttgttataaatataacactataactttgatttgtaaaaaggaggaattagtactatccaacgaaaaaaatggtagataaataatgggatttgaaagggcagatatgctgcgcagaagttttacacactttatttttatttcaaaatgcgttacactagacaaaggggtattttctcatatttattttgggacttatcctgatacgcaaggaggtcactgctttcatgaaactagaacattttcattatctgttggaaatccacaggttccactccatctcagccgcttcccgtaagcttcacatcggccagacaaccctgagcgcgattgtcaaggcggctgaggaggaggccgggttccagattttccagagggcgccggaaggagtattgaccacctcagcaggagaaaaattcatgacccttgcctgggaaatcaatttacagtacgaaaagctgatggcgctcaaacgccgcacaacagccggggccccatccatcaatgtgctgatggcgcccaccatttccgtgcgcctgtccatacctctcctggagcagttttaccgtcttaatataccgggcggcctgtccctggaagaatgttccagcgaggacatccctggttttattttggaacacagggcaaatataggcctgctttacctgtccggagataccatctgccagtttaggcatggcagcgggaatccggccctttccatcaaaccactgctggaagacagcctttacctgcttgtatccaaaaaccatccgctggccggactcagggaaattgatgcccgttccattcccctggaacggctggccaccataaaactgatgaaaaatgatatggtgctcggttcccttccctccctctgccccagcgtcaccagcttcgcagacatgagtgccatgtatcaggcaatacagaaccagggaatggttggttttatccccggattttcagcgggcggtgaatctgctgaagatatcagggacttttccatgatttccttaaaaaacacggaacatccaaaccagctctacctctgcatggtcacatgcagcgaccggaagctgaagcaccaggaagaagtcctggccacatgtatcaggagatatttccgaacagtcagccggagaaaagacaatgatcaggaggagacagcgcgtgaagattgaacagctcaaatatctgattgaaatcgggcgcagccgctcaatctcatccgcagccgggaagctatacctgagccacactaccttaagttccatcctgaaaggtgctgaaaaagaattgggattccccctgttccagagagtacagggaggtgtgaaggtgaccactgaaggcgaggaagccctggcccttatggaagaaatgtatcgatgttttgaggatatacaaaagctcagtacggtcaacgccctgcttacccagcccgtgtccatcgtcatatcccccagtatccacagcgcactggcggttcccatcaaccagctgttctgggagcaggaatccaggggaaggctggaattccagattgtgaagggaatggacgtggggtcccgtctgattaaaaatagcggtaatcttggcctgacctattttacggaagaaagccaggaaaattaccgcatgattgcatcccgttaccagatacggacagactgcctgtataccgaccatttttacctcctggtgcgaaaggaccatcctctggcaggaaggaggcagatttcccaggaagaactgcagaacattgacctggccatgttagaacactatgttgcatcggaaacctgtccggtctatcttaaaaccctgggaccggacaaccgttacactattttcagcaacattgccctgatcaggcggagcatcttaagccagaacatggctgccatcctgcccggcctggccatctgcagcgcgcccggagataaccatcatctttttaaagcaattccgctcattgaaacagagcagaatcccaataccatgtatttgtgcctgctccaccgcggggcagccagtctgcgtgaccaggaaaagactgctttaaactgcatcaggaactattttaaggatcttaagagccttcccgccctttccattcttccagatgcctgaccgcctgtgaaagcttcatgctgttggaccctttgaacaggacacagtccccctgcttcaggttcccattaagccactgccctacctgttccagttcctcacagaacaccacgggcaccggggatgaggatgcgcatagcccgtgtccgatttcagccgccaatccgcctaaaagaactacctggtccaccggatgtactgctatgtattccccgatttcccggtggaacctaggcgcatccggtcccagctccttcatgtcggccagcactgcaatcctgcgcccggttccttccggttccatggaaccaaggacttccagcccggccttcatggacacagggcttgcgttgtagctgtcgtcgatgaccgttataccgcccttcagcgtgaaaatctgctggcgtcccttaaacccctcaaattcttccagcttggcggcggcggcttccatgggtatcccatattcatgggccactgccagggctgccagggcgttgcttaccatgtggcttcccatgacccgcaggcggaccgtgaccctcttgttttcatggaccgcgctgaacaccggatatccattcacaaggtgcaggtcctccccccggtactggcagtcatccgacatgccataaaggattttcctcctgttcccctcggggatgacggaccttaataatccgtcatccccgtttaatatcaggcttccgttttctgccatcccatcctgtatatgcagcttctccttcaggatattatcctgtgagccgagctgctcgatatgggtgactccgatattggtcatgacggcgcagtccaccctggctatcctggctatccttgtcatctccccgggttcactcatgcccagctcaatgacgccgatctgggcctgctttggaatcgctgctatggtgatggggacccccacctggctgttgctgttgcccggtgtcttatagacggtaaagccggcgctcagggcagccgctatcatctccctggtggtggtcttgcccacgctgccggtaatccccactaggggaagcttctggcggctcctgcagtatataccgaaatcctgaagcgcctttttggtatccgctaccccaatccaggcagcggacatggcagcttccatcctggggacatcgtacccgcactgtctgatgatatccgccctgacctcctccggctggcggtggcggctggtgaataccgcggcggccccattgacgatggcctggcagagaaatccgtgggcatccacattttcaccgatgatgggaacaaagaggtcatccccctccatcttccgggaatccagactgatatgccggatgggcgtatcttcctttcccaaaagaagtgttcctcctgtcgccaggactaaatccctgcacgtgaatccatccatgctcatgcctctccacccagctttcccaccacctcttctatcacttccctgtccaggaaatggtggcgtactccgttgatttcctggtagtcctcatgtcctttgccgatgactgcaatcatgtccccgggcattgcatggcttatgctgtactcaatggcctcccgcctgtcgggtatctcaaggaacgcgcctccggtcttctcgatgcttcccctgatatccgcaatgatgtcctccaccttttcatagcgggaattatctgctgtcacgatgcttaaatcagccagccgtccgccaatctcgcccatggtatacctgcggtccttggaacggttccccccgcagccaaagaccaccaccaggcgcttcggatgatactggcgcagggtggtcagcaggctttccatgcttaccgcattgtgggcatagtccacaagtacggtgcacctggcagaggtgtgtacgatttccatgcggccgttgacacggatatgctccagggcacggctgacgcactctttcttaagccccaggaaactgcacacgctgactgctgccagggcattatccacattgaaaagtcccgggatcccaaggcggacatccatctcatatctgccctttacatcaaattcagtgcccacgaaatccggctgggacacataacggacatctgaagccgtaaaatcagccccggactccccgcttccgtgaagtccgcccctttcttccgtcacgctgtaggtataaagctcacagtccgcgtccttaatgatatcctcaaagtggctgtcattccggtttaccaggccaatcctgcacatattcaggagcctggatttacagtacaggtattccgcaaaatccgcatgttcatccggcccgatatggtccggggaaatgttggtgaaaataccgtaatcaaaggtaatcccatccacccggtgcatcttgatgccctgagaggaaacctccatgatcatatactggcagccgctgtctgccatctgtgcaaatgcctggtgcagctgccaggattccggggtggtattcatggtcggggtcaccttatcgcctatgacggtgcccgtggtgccgatcatccccacctttttgcctgccgcctcaaggattgtcttaatcatatgggtggtggtggtctttcccttggtgcctgtgacgccgatggtaaccatctttgttgccggatagccgaacctggcggctgacagaagggccagggcatgccgtccgtcccctgtctgaaggaccgtgacctcagacagatcttcctctgtcagtccgccttcctcctttgccttcttaagttcttcctcaatcccccgctccgtcaccaatacccggacgcctgccttcagcacatccggcacaaaccggtgggaatccaccctggttcctgccatgcacacaaacaccgcccccggcgcagcctttctggagtcataaaccacttccgatacttccgtgtccaggctgcccctgatacactcatattcaagtcctttaagccaatctcttaataccattatgaagtcctctctgtctgttctgccttgggcgtgtttgaaaattgctttccgccagctgtactagaaaagtcctgttatccttccattcttatccacatcaatattctcagccgccggtttcttaggaagtcccggcatggtcatgatggagcctgtgagggcaaccacaaaacctgcgcctgccgacacataggcatcccttacattgatggtaaagccagtgggcctgcccagctttgtctggtcatcggacagggaatactgggtctttgccatgcatacgggcaggttggcgaatcccatgtcctctatgttctttaatgcctttgaggcagctggcgcataggacacaccgtccgctccgtaaatctccgtggcaaccgtgtggattttatcctttaatgatatatcatcgggatacagcacacggaaattggacggcctgtgctccagggtttcaagcactttctgtgcaagggcaatcccgccctcgccgcccttggcccagacctcggaaagggcgaactcgcagcctctgtcctcgcagaacttcttgatataagcatattctgcctctgtatcggttatgaaggaattgagggtcacgatgacaggcacatcgtacttctggatattctcaatgtgtttttccaggttgacgataccgcgctttaacgcatccaggttctccccggacagctggtccttgggaacaccgccattgtacttaagcgcccttaccgtggcaaccagcaccactgcgtccggcttaaggcccgccatgcggcacttgatgtccagaaacttctctgccccaaggtcggcgccgaacccggcctctgtcacaacaatatccgccagcttaagggcagtcttggtggcccttacgctgttgcatccatgggcgatattggcaaatggtccgccgtgcaccagggcgcctgtgtgctccagggtctggatcaggttgggctttaaggcgtcctttaaaagggctgccatggagccggttgcatggaggtcatctgcggttactggctgtcctgcaaaattatatgccacgatgatcctgcccagacgggcctttaagtcctccatattgtcagccagacagaggattgccatgatctcggaggcaaccgtgatgacaaagtggtcttccctcaccatgccgtccgcctttgcccccaagccgatgacgatattgcgcagcgcccggtcattcatatcctcgcagcgcttccacatcacctgtcttgggtcgattcccagtgcattgccctgctggatatggttgtcaaggagggctgccagcaggttattggccgaggtgatggcgtggaaatcccctgtgaaatgcaggtttaagtcctccatgggaaccacctgtgcaaatccgcctcctgcagcgcctcccttgattccaaagcagggtcctaaggacggttcccgcagggcgatgatggcgctcttcttcatgcgcccgaatgcctcgcccaggcccaccgttgtggtggtcttaccctctccggccggggtggggttgatggccgtcaccagcaccagctttccgtccggcctgtccttaaccttgtcccacagcttatctgtcagcttggctttatacttaccatacagttccaggtcatcctcggaaatcccgtaagacgccgcaacctccttaatgggctgcattactgcttcctgagcaatctcgatatctgacttcatgggtatatcctccttgttttttatatcatttatgtttactgttccataaactcctcaaactcctgtgcgctcataagtatcttcctgggcttggttccttcctcctcccccaccacgcctgcttccgccagctggtccatgatacgcgcggcacggttaaatccaatcttgaacatcctctgaagcatgccgatggatgccttgtccttttctatgatgaacctggcggcctggatgaaatactcatccctgtcgctctggctgcttcccgcgtccatggaaggcgaggataccctgctctccacctcaggactgtactcagccaccatgccctgttccgtaaggaaatccactacccggcccacttcctcatcggacacaaaggcgccctggacacgctggggctttggaaagcctgccggataaaagagcatgtcccccttgcccagcagcttctcagccccattcatgtcaatgatggtcctggagtccacgccggaagatacggaaaatgcaatcctggacggcacattggccttgataaggcctgtaatgacgttaactgaaggcctctgggtggcaatgaccagatggatgcctgctgcacgggccagctgtgccagacggcagatggcatcctccacctcgcctggggccaccatcataaggtctgccagctcatccacgataatgacaatctggggcagtttctgaggttttttctcatcctcaatatccttaatcttttcaaccctttcattatatcccttcagatccctgacattgcattccgcaaacttcttgtagcggtccgtcatctcagccacggcccagttaagggcgccggacgccttcttggggtccgtgaccaccgggatcagcaggtgcgggattccattatagacgctcagttccaccaccttggggtccaccatgatcagcttcacatcctcaggctttgatttgaagatgatgctcatgatcagggtgttgatgcacacggatttaccggaacccgtggcgcctgcaattaaaagatggggcatcttggcaatatccgtcaccaccacctgcccgccgatatccttgcccactgcaaaggccagacgtgacttgtggctgatgaatgattccgcctccagaagttccctaagatagaccatgttgttctctttattgggcacctcgatgcccactgcggacttgcctggtatcggcgcctcaatccttatgtctgcggcagccaggctcagcttgatgtcatcggtcaggcccacgatcttgctgaccttaaccccctgttccggaagcagttcatatcttgtcaccgcaggaccgcagcttatgttggtcacggtaacgcccaccccgaagttgtgcagggtctgctgcagcttgatggccgtggccttgtattcttcacctgaaaatgcgcctgcgctcttgctgcccttcttgagcagggtggtgggaggaaatacatattccttcttgaccacctcttccttcttcttaatctcctctgccacggaaatctccgtatcccctttggcagtcccttctttctttttctctatctttttcttaagcagttcggtctctgtttctatgaccttgccggaagcggtcaccacacgttttggttcctccggcacaaacacgctgtcataattaagcccctgttccgagtcatcctccatatatgtatccgtttcagggaaatcctcctgctgccctctggcgccgtcccctgtccctgggtcctcagtccctgaatcccacgggacctcctcttcgggccagccgttcccctgtgcagccacagccatatccatttcttccagggtgcgggaatccttatgtacatggatgacatcctggctgccttccaagccaaatccatcttcctccacggttattccggtcaccaccggagcatcttccctcctgtgtctgtgtccttcgatggaacgggccaaggcccccacgtcatccatgtcaaaggaggcatcttccccggtcccatgttccaatggcgggtcgaatttacctctgaattcattgaccggcgcagcagcggccccgcggtccagggacggcgcagcggcagcccccacacggcccagggaagcctcgtcctcatatggttcctccagcggctccaaatccgcgccgtattcccggtcaaatgcctcctcgtcatactcatcgtatccgccgtccccgtcgtattcatcataggcagtcagccgggtagcgtccagattgactccccgtaccttctgctcctccctgagacgcttcctctcttccgccctctgggcgtggatttccctgcgcctgtccatgtcttcccttgcatactggtaagccttgtcaccgccctttttcaccacgctgacaaaggaacgctccgtgatgcacaccatgcagatgatgaacagcacggcaagcaccaggaaggtccctggcttacccaggcccaccaccaggaaggaggtaaggataccgcccaggaatccgcctcccacaccgctgagggtggactgcttataataatccccccagggcgcccctgccggggttgtcccgaaaaacagctgcagcaggccgcatatcaccaggaccgccaccaccacggcagccagcttcatggctgcatggaggttgccctggttggaaagatggaagcaggtacccacgaatatcaatatgggcaggagataacccaccataccaaaaatccccagctgtacgcccctcagcacatcgccgaccacgccgcataacttaaagttgcttaaaaacaaaagaatggcaacagcaaaagagcagatgatgaccacttctgctcttataaactctgtattctcttccgtatacccttttttacctgaggctttgcggccctttgagggagttgtcttcttccctgcggtactgccctttggccttcccggttttctgttcccactctgctgtcgtttacttgattcagccacaaacatagccccctgtcattctcttacaagtctttttgccaggcccgcgtatccggcatatccatttcttccatttgggcccaggtacatttagtatacaaaaaaatcataagaaatgcaactttaacattttggggctgtctgtatccgccaatctctccgtatccgccaatctatctgtaacgctatctgtaacgctttctcccgtcaatcatctcataaagtttcccaagggcttccttaatcccgccaacctggttgatgagccctgcctccactgcctgttcccccaccagcacggttcccaggtccctggtcagcatctttgtattgtgcatcaggtcccttaactggtcatatgcaatgtcggcgtggctggccacaaaggtaaggatcctgtcctggatcatttcaaaatactcataggtctgggccgtgccgattaccatgccggtcatgcgcaccgggtggatcatcatggtccctgagggcacgatgaaggagtaattggtggaaacagccagcggcacaccgattgagtggctgccgcccagtaccagggatactgtgggcaggcttaaggatgcaatcatctcggcaatggccaggcccgcgtccacgtcaccgcccgacgtgttaagcaggaccagaaggccatccacgctgtcatcatcctctatctcagccagcttcgggaggatatggtcatacttggtggtcttgctgctgccggaggaattctcatgtccttccacctcgccgatgatggtaatcagatggattttcctctgcttctggttgtcctccaggataacctgtccgtattcctccagacggttgtcctctttttcttctatctcacgttccagtcttttagcctcgtcatccttttttaccggctcctggtcatccattttctttttgctgtttttcgcctgtcccatggtcgcaacttcctttcatgaatcatcctgtgttggtacactttatccattagtctgcacttccgggacgaaaatatgcatgatatgttttcatgaaacagaaaacaaaagaaaaagcagccagccccatgtctgtcccatgaaggctggctgctgccggaaatctttatttcatccattctttatctcattaatcgcctaacacgttcctgatagccaccggggacctgtagttccaggtagatatcttgatgccgctcttgcggctggctgcatggacaatctgtccgttgccgatatacatggccacgtggtttacctggccgccgctgcccgcgtagaatatcaggtcgccgggcctcatgttgcctgaggtcaccgccttgcccatcttggcctgtgagcctgaataatgaggcagtgacaccccgaatttggacaggacgctcatggtgaaaccggaacagtccgcgccctttgtcaggctggtgcctccccatacatatggattgcccacgaactggagcgcatagttgacaatctgtgaacggcgggacgcggcattgttggccgcaacctctgccggcgagaacttgattgcctcgttaagggcatagcgcacctccacgttattatcccttgtggaaatgtaagccttgtccgtggtggttccgtcttcttcatccacggaatccagttcaatctccacccatccgtccagctgggccacaacaggatagcgctcatccttaacaatctgggtccatatcttggcatcggtggttggttccgtacgcacgttcagcacgtccgtgttgatgaccgcacgcagggttgcggtctgcatggcaatgtccttggcctcctgccctgtcgccgtgtactgggggtccgcggaaatatatccgatgatggggccggatttaatcttataccagccgtccaaggtctctagtacctctccggccgccttactggtcatcttaccgatgatcttgccgtcgctcttaggttcctcgcggacattcagataattattcaccttggaaatgaccaggttatcatactggttgatggccatggccttcatatccagcttacggccttcattcagggaataggatacttctgcgtaatcagcggaaatatatccttcttctatctggatccatccgtcctgctgtcccaggaccacgtagcgctcgcccatcagcgcctgtcccaccacattgctggggtccagttccggggcctgcctgatattcaggttatcggtcgtgaccgtggccctcagcttcaccagttcctttgccttttccctggcttcatctcctgaaatcaggtactggttgctgatatagccgtccacgccgcctgacgtgatatgggaccagtcgccttctgtctgcaggatctcacaggccccgtcaccggaaagcttgcctatgatcttgccgtccgtactgggcgtctcgcggatattcagatatccggatacctgcacgatacccaggttggaataggaatcaatggtcttttgtatctcctccgcttcctttctggctgcttcctcctccggcgaaggctcgctggccggctgggcatcggaggcggttgctgccccggcttcctgtaccggcctgtttccggatgcacggcctgaggccggctccttcatggccgcctttacaccaagtacgatgattccaaccacgatgactgccgccagcagaatcagcaggtatctggggtctatgttctgattgcgtttcttcctggccttgttcaggctcgagatataatccttgtgttcaagcatgattccattcgtctccaactttgtttttcggcatgtaaactcatacagcgtaaagtatatcatagatccatgggctaaaatatgaaaattttcttaaatttggagacaggccttatttggccagcatcatgcggtcattggcaaactcgccgccgctggcttcggcgaactttttaagcaggtcatccacggtcaggtttttcttttcctcaccggatacatcgtaaatgatgcgtccgtcatgcatcatgatcaggcggttgccgatctggatggcgtccttcatattgtgggttaccatgagggcggtcagcttctgttcggttaccatctcattggtaaggtccaggacctttttggctgtctggggatccagggcagcggtgtgttcatccaacagcagcagcttcggcttctggagggtagccatgagaagggtcagggcctgcctctgtcccccggacagcagccctaccttgctggtcatcctggtctgcagtcccagacctaaacgggtaagcatgtcgcggtaatagtccttttccttggcccggatgccccagccaagtccgcgccgtttgccgcggcggaatgccagggccatgttttcctggatttccatgcctgccgcggtccccttcatggggtcctggaacacccgtccaatgtatctggcccgcttatgctccggctgtctggagatattgatgcctccgatttctattttcccggaatcgattgggtatacgcctgcaatcatgttgagcatggtggatttacctgccccgtttcccccgatgaccgttacgaagtccccgtcatttaaggacaggctgattccgtttaaggctttcttttcattgatggtgcctttgttaaatgtcttgcgcacgttggtaagttcaagcattagttttcccctccttctgaataggcctgatgtgctttccatttggcggcagccacaggtacacacagggccagggccacgatgacagcggaaagcagtttcatgtagttggggttcaatcccatctgaagcacaatggcacggatgacgaagtagatgacggaaccgattaccgccgccgccagcttacatgcaaaattcctgaaccagccaaagagcacctcaccgatgacaatggctgccaggccgatgacgatggctccggtccccatctggatatccgcgtatttctggctctggcataccagggcgcctgacatgcccaccaggccgttgctgagcatcagggccagcagcttggtgaacttggtattgacgcccagggcgcgtatcatgtcttcgttgttgccggttgccctaagggcgcttccgatttccgtcccaaaaaaccagtaaaggatggccaccacaatgacagccacaactatgccgatgacctgggaggactgggcctggctgagcccggctgtgccggacagcctgctgaccatggtatccacctttaacagcggcaggttgctcttattgcccatgatccacagattgatggaccacagggatatctgggtcaggattcccgccaggatggaaggaatctcaaatacggtgtgcaggatgccggtcacaaatcccgcagccatgcctgccagggttgccaccaccagggccgccaccggattcctcaggaacaccgccaccgggtgcatggacttgtttaagatcagcatggcgcatacacagcctcccagggcaaagcttccgtccacggtcaggtccgctatgtccagcagcttgtatgtgatatatacgcctaataccatgattccccagagcacgccctggcccaccgcgtccaacatcgcagggcccatgccctgcagtgcatttaaaatgttcatctatataacctccatatgtactgttaactcctgtcactgccccgctgtcttaataaatagcttgcccaaacagaccacatcctcaccagacggcttgagcaaaccatctatatgaaaccatcaggccccaccggtacgacctaaaacgggtgccgcgtaaggcgggaataaacccggcctcactgcggcaccgccctttcatccacctgcatttccattcaatctgtaaaatactgccttatttcagattggatacatcaataccaagtgttgctgctgtctcctcgttcacggtcagttcacacttttctgccggaagatattcaatcggcatatcagcaggtgatgccccttctgtaaggatccttactgcctgctgtccggtcatgtagcccagccgatagtagtcgatgccgtaggttgcaagtccgccgttatccaccataccggactcgccgcagataacaggaaggttattgtcgcctgccaccatgcctacggttgtcataccggctgcgatggtattgtcagtaggcgcatagatggcgtccaccttgcccaccatggactgcaccacggtctggatttcgttggaactggatacggtgaagtcctggcttgtcataccggctgcctcgattgcttccctggccatctgtgcctggatttcagagttggactctgcggagcagtaaaggatgcctaccttctttgcatcgggaaggatctgctttaacaggtcaatctgctcctttacaggagtcaggtcagaggttcccgtcacattgccccctggcttctggttatcgtccacaagaccggattcagccgggtctgtcactgcggtaatcaggaccggtgtgtctgtcaccgcgcctgccactgcctgtgcggccggtgttgcgattgcaaggattaaatccttcttgtcattggcgaacttggatgcaacggtctggcatgcggactggtcaccggatgcattctgggaatccaggtcatattggatacctgcctcatccagggctgcgagaaagccctcgttggcagcgtccagggccgtgtgctgtaccagctgaaggatgccgatcttataggttgtgccctctgcggtctgtccctcaccctctcctgcctcggatgaagcctctgtgccttccccggaagatggggctgtcactgcctcagtgctttctgttcctgctgcttttgtggtttctgcggtgctgccgcctgagcatgcgcccagggacaggaccatggctccggccaagaccagagacatgatttttgatgtctttttcataatgctctctcctcttttaacccaaatattgctcccattcagggatgtttcctatcatactacaaaaaaattccgccgtcaattttattgctttaaattcctgtggttttaaagcaataaagtgtatttttttcagtacaatgcaaaaggaaagcttatgccctggcctgatccatgggaatggtcaccacaaactccgtgccctgttccagcttggaagtcacatggatggttccctggtagaaattcacgatgtgctttacgatggacaggccaaggcccgtaccgccctgtttgcggctgcgccccttatccacccggtaaaaccgttcaaagatacggtccaggctttcctcagggattcccattccgttatcccttacccggattaccatgttgccgccctgctcccggatattgatccacacctgtccgcccggatgattgtacttgaccgcattgctgagcaggttggtgagaagttccttcatctgctgcacattggcccggatgcacaggggctggcagtccgcgtggaggaacacctggctggacgctgcctggggcttcaggctgtccatgatttcctccagcagcacgctgatgcgcacatccgtcaccaccacctcggcgtcttttgcctcaagctttgagatcatcaggatgtcgttgatcaggccggtcatattgaccgcctccttcttaatccttctggcaaaatccattttcatggattcatcctggatcagaccgctttccagcagctccgcatatccctggatggaggtgatgggtgtcttaagctcatgggaggcattgctgaaaaactcctggcgtatctgtttttccttttcaatctggcttaagtactccttgacattctgggacatgttggtgatggtctccgctatgacgttgatttccggatactggtacctgtcaaaatgaagttcggtgtaatcccccttaacctggagcattttcccggaaatgtccctcatgggacgggtcacggaggagacaaacctctgggtggtcaccaatgagcatatgagggctgccaggaagcttacaagggctgccgggaacagcatgggcaggtattcgctgatgccggaataaggcacggccaggcgcagcaccatgtccgcatggtctgaacggcaggccacatagagcatggtcttcttaagggtggaggaatacctcctggcatatcccaccccttcctccaccgctttcctgatttcctccctccccagatggttgtccaggtattccgcgtccgcgtcggaatccgttatcacggtcccatccgtccgtatcagggtaatccggctggagtccatgtcggtaaatgcttccagatgctgcatctggcccattaaatccccatcataatccagtatgctgtcaattgccttgatggtatatctcatatccctgctggatgtattcagaatcatgttgctgcttgcaatataaaatatgacgctgtgaatacacagcgccgctaataacacaaggacaaaacgttccaatatggccttacgcatgatttcctcctttgttccattcccactaagcatccgccttgatgacgcggtagcccacgccccggaccgtcttgatacaggaaccgccctcatcgcccagcttctggcgcagggtgcggatgtgcatatccagggtccgtgtctccccgtcgtattcgtagccccatatccggtttaacagttcatccctggtaaccacccgggactggttttccagcagatagaccaggagttcgaattcctttaaggtaagctcgcacggatgcccgctgctgattacctcccttgtcttacggtttaccgatatcccctgataggacaggacgtccctggactcctcgcgccttgttctgcgcagcaggctgcggatgcgggcggaaagttccagcaccccgaagggcttcaccatgtaatcatccgcgccgcagtccagccctatgaccttatccagttccttttccttggccgtcagcagcatgatggggatgtccttaaggccgtcggtctgccgcacctgcttaatggccgtgattccatccatcccgggaagcatccagtcaaagatagccatgtccggctgttcctccttcatccgtttaaggccctcttccgctgtctcaaacccctcagagccgtaaccgaatccctccagggcaatctttaacaggttccttatattctcatcatcctctatgatgtaaatcttctccattctccgcttatccgcctttcccggcatgcctgcctgttctatgtaaacagcataccaaatgcaagtaaaatccgctccataggaatgtaaaatccgcgtaaatttttcaaatcagaggatttccctgtaaacgcgaagcacatttttgtaaaatacagcctctatatcggactggctgaacccttcccgcttcatggcatccgccagcatgggcaccatggacgcgtccttcatctccagttcgcattcaatgccgtcaaaatccgaccccagcccaagacagccgattcctcccaccttacggatgtgcttcatgtgttccaccatataggatacccggctgaccattgcctcatcctttccaaaatcccttaagaaacaggtatagtaattgattcccatgacgccgccccggttggacagttcccgtatcatgtcatcggtcatgttccttggatgggaagccactgcccttgcattggaatggctggccacaaacggcttcttcgtatgcctgaacacatcccatatgcctgcatcgttcagatgggatacatctatgatcatgcccaggcgctccatctcctccacaaacccaatcccggtcccggtcaggccattggacctgtccggcaccacacaggtggtcccatcctcacgccgttcccttttgttggggaatcccagttcattggggaaattccaggtcagggtcatcatcctgacacccagacggtagaaatcgcgcaggaacctaaggctgccctggcatacgccgccctcctcgatggtcagtaaggccgacatcttccccttcttccagttgtcctcaatatcccggtaggaccgcacgatgccgatcatgtcactgtgcgcctccatctccgtataaaatgtgtccagaaggcccatgcagtattcaaatggttttccctccgcccgttccaggctggtgaacagtgcaaaattctggagtccgtaatcccctgcctgcattttcttaaggtctatcatcaggctgttctccagtatggaggcgctgcctcccttcagatggtccttatgtaattcagatatggtatcacagtgcatgtcgatgactttcatcctatatcctcttttcgcgttctcgtattgacaatctattcccggcagcatgggtttatgcccgtgggcatagcttctttccatctgcccggtcatttccagtctatactgatccactgctcctgtcaatggcagaggcgcgcagaagggccgcatctatggaggcgcagatattatcatgtccgatttcccggtcaaagcccgacttggccatgacggacatgggctgttcattgacatgggacaggatcatggtcacatgcgctttcctgcagcgcccattaagcttcttaaggctgttgagggccgtggcatccatggccggaacgctgcgcatcctgagtatcagcacattcttcctggaatcaaggggtatctgggcaatcttgtccgccgcgccaaagaacatggggccgctgacctcgaataccatcacatgcgcggggaccggctttaagtcaatccgctccccgtcctccccttccctgtaatcctccgcatacttccatccatagatatcggacacgtccgccatccgtttcatgaacagcagggaggccagcacaagccccacgccgatggccagcacaaggtcaaagaccacggtcaggaaaaatgtgattaacagcactgccgcgtcacttttaggcgaggttttcaccacatcaatgaattccctccactcgctcatattatatgcaaccatgaagaggatggcggcaatggcgggcatgggaatcagggccgcatagggcatcaggaagataagcaccagaagcagtaccacggaatggaccatgccggccaccggtgtgcgtcccccgttcttgatattggcagccgtcctggcaatggcccctgttgccgggatcccgccaaacaaagcggatgcagcattgcctgcgccctgggcaataagctccatattggagttgtgctttcctcccaccatgccatcggccaccacgcaggataaaagggattcaatggcagccagcactgcaatggtcagggcatccggcatcaccttctggatcaggccaaatgtaatatggggcatatggaacaccggcaggctggaggatatggtgtacaggtccccaatggtattcaccttcaggtccagccccttcacaagggccgccgccgcaatgacggccacgagggacgggggaatctttttgacgaatctgggccatatgatgaggattgccagggacagtgcgcctatgagcactgccatggggtttaaggtatccatgcatgcaaggacttccctgagtttttccattgtctccaccggggaatgtaaaaaggtaatccccatgaagtccttaatctggccgatgaaaatggtaacggctatgcctgttgtgaatccggtcgtgatggtatacggtatgaaccgtatcaggctccccaggcgcagcacgcccatgacaatcagcaggatgccggccagtatggtggcgacagccaggccttccatgccgtttttcaggacaatcccggccacgatggtcgcaaatgcagcggtggggcctgcaatctggaccttgctgcctcctaaaaaggagatgatgaagccagccacaatggcagtataaaggccctgctccggcgtcacgcccgaagcaagggccagggcgatggacaatggcagcgcaatgattgccacgatgatgcctgatatcacatctgctgtgaattgcttgctggaatactgtttcatggacagaaacagctgtggtgttaaatctttcatactcatttccctatcctttgttaaatataaaattttcataaacaatttaactatatatggaaatgggtggttccttcaagacctttgcgcaatgtttctcatctaatacaaaatcctactcgctcctgagggcatcaatgggatttaagttagctgcccggttagcaggcatataaccgaacagcagcccgatccccaccgacacgctgaaggatatgatgacggctgccggcgtgggcgttgccgatatccccacggccgtccccaccagggtggttgcaacgcagccaatcaggattcccaccacgccccccagggaactggtcacggcagcttctatgacaaactggcgcatgatggtgcctttgtcagcgcccagggacttccttatgccgatttccctggtgcgctccgtgacagacaccagcatgatattcatgacgcccacgccggccaccagcagggaaatgcctgcaatcccgcccagcatgccgctcatcatggcaatctggtcattgagggaatccagcatctcgctcatggcggtcacacggtacaggtcatcgtccttgaatatcccatagagatggttttcaatggcagtcttgcactcatttgccttggtggtgtccagggccgtaaaggtatagttgctgatattggcgttcctggacatcttgacggcaacactgtaaggcagccatatgaagtcatcggttcccccgtcttccatgccatcctcttcctgggcttccaccacgcctacaatcttaaacgcatacccatctatctttatggtttcatcaagggccttctcactgctgccgtaaagttcctgggcaacatatgccccaatgacacagaccttctgcctggatgcaatatccgcataggaaatattgcgccctaacttaaggtcgtagtccttgatatccagatactgttcactgcggcccgccacgctggtgctggacatggtgtcggtcccgtgcttgaccgtggaattaagggtcacgttggggctcagcccgccgaacagatccgtgttgtcctcgtaaaacccatacatctggtccacgcttaaggacctggagcttaagttggtaacattcacgttaatctggttcacgcccatgctggcaaagctctccaccacgctgcccatgtagccgttgaccaggcttaccaggatgatgacagccgcaacaccaatgatgatgcccagcatggtaaggaaagaacgcatcttgttgccccatatacttttaattgccagcttgaatgattgcagcatagtctttcacatccccatcaaaattaatctgtccgtctgtaatgcgcaccacgcgccttgcttccattgcaatggaattgtcatgggtaatcatgacaatggtattgccctcttcatttaactgtttcaggaaattaagcacatcccggctggttttggagtccagcgcgcctgtaggctcatccgccaggatcaaggacgggcttcccgccagggcgcgtgcaatggaaaccctttgctgctggccgccggaaagctggtttggcatgttcctccatttttcctccaatcccacctttttaagggatgccatggcccgttcacggcgctcgctgctccccaccccggcatacaacaggggaagttccacattttccagaaggttcagtttgggaagaaggttatactgctggaaaatgaaaccaatcatcttgttgcgtatatgggccagctgcctgtcgctcatgacgcccacgtcctcgcctcccagcaggtattcgccatccgtaggcacatccagcgcgcctattatattcatcagggtggatttcccgcttcccgactttcccacgatggccacgaactcgcctctgtgtatggtcaggttgatatcatcgttggcccgcacttcctcgccgcccagataatatatcttatggatattcctaagttcaatcaacggtccgtcctgctgcctgtcatccatgttaatccggctccttatcatttttctcagatagattcattattgtttgtccagccgccacagggtaaccggatggcattttatctggctccgcccataccgccgctgcggctgcttcctccgccattactccggtttccgccgcctgacgggccgcccatgcctccgcccatgccgccttcccgcatcatcatgaagctgctgccgctgttcttgctggactcggccacatagaccacatccccttctgaaagcccgctcctgatttccacataggaatcattggtaagcccggtttccacctttaccgcccggaacccggccggaaccggaccctgctgctccgtcacggtctcatcctttacataaacctggtttccgcgcatcagggcatccaccggaaccgtaagcacatccgaagcttcttcaagggtaatgatcccatccacattcatacctggaatcaaatcgcccatctcatccattgtcacggtcaccgggtaggtgctgacgccgttggaatacgtactttccaggcttacattggtaacggtgcctgaaaatgtctgcccctccatggcatccgccgtaatgaccaccttctgccccaccttcaccttctggatatccagctcatcaatggacatctcaaaggtcaggctggacaaatcataaatggtagccaggaccgttgtgctcgaactgttctttgtgatattgtcccccaccttgaagttcttggcaatgacctgtccggatatgggtgctgttatggtatagttatcataattatcctggctgctgtccagtttgttctgggccgactccacgctttcctctgccttgtccagtgcgtccttgtaactgcgcaccagcttatccgctgacttttccgtcattctgaacaggggggtcccctttgtcacatagtccccttcgttcaccagaagggcctcaacctccacactggtggacaggtccgcgttcatggtggtgtccacggacgcctcaaatgcgccgtcctcactgcccacaaattccccaatctgcgccgtggccttcatcgtagtggtaagaccgcccggattggttacagtgatggtcacattccttacgatacgtcccccggtcagggtaatatcctggtttgcaaccgccttgaccgcgcctgccagctgctcccccgtatcagtcagggtgagaacggctggcgaaccaggtccaatgagggctgcctcgccggacaggaagggaatcctgatttccatcacatcgtcgctatagacatccgcaagcttggtgctgccacccaccttatcgcccacgtgtatgtataactccttaatatagcccgtgtccgtggccttgtatgtattgccgctgtaatcactgagcgcatcctcataatcttccctggcatcctcataggaggtctgtgccctggtcagggaattggtggcgctggtcagttccgattccatgctggacttatcaatctcataaaggacctggtccttttccacctggtccccttcctcaaaatcagcggaaagcacctcgccttccaccatggaagtaatgttatatgtatcctttgccgccagtgtgccggaggatgacagttccgaggaaatgctcctcttttccacaaccgccgtattctgcgtctgggcgccggccgctgccgccgatgccttcatgctgcgccgcaccaggatgaccattatggcggccccaatcagaaggagcaccaggaccggcttcagccatttccgcttcttccctttggatttccctgctttcttaccggttttgtcccggcttccttcattgtcacttcctgtatgatcccggcccttttttccgggaaacggtatctgtcccgctaaatgcgccaggccctttttcttctcttccatcctgcacctcaaccattaatattcgattgcgtctactgccgtataagtggaaccgctcttattgcacaccatcacaacctcatcccccacctcgatggagccatagatggagaacaggtactgaagctcagaggaatccaggttaatggtcaggtatccgttctcatccacggaagcatcatcaaaatcaccgtccgaattgtcctcgtcgatttccagacggatggaagtgggtgtcatcacatccgttgacttataatatatgttcttgacctctccctttaaaagtgcatacgcattattcccctccaggtcatcctcgtcccagcccctggtagtatacgcccatatggtctttgacttcacattatagtaaataaccgcaaatcccgcctcctgctgggatgacttcacattcgccagtgtgctggccacaccgttaaggaacacattggcattatcagtgtcaaagggtacggactgtgccacactgaagcccttgcgcaccaggatcggtcctttgcgctcgtcatccaggatggtgatgggattgatttccccatctgaattcagttcacagtcaaggaccgcgccatatatctcattgctatccttttttttggtcttcagcaggttatagaatatgttcatgcagtccgtctggttcaacacctcctccggctgccggctcacctcttcattaagctccaggtaattgaacttggaaatgcgcgaagacgccagatccccggtaaaatcctcatccgtataccccagcatggtcagggccgccttcacagcatccctgtaggttatgtactcaccgggcttaaacagcccgcccaggaatccgctcatccatccctgggatgcggcaatcctgatataaaccgcattgggatccgttgacgggacatccgcaaacacagagacattggaaaccggaaggttctcacggtaactggaagcatggaccagcatcctcgcaaactcccccctggtgacctgttccgtataatccgtcacgttcaggattccggtcaggctgaccacctgcttacgcatgtcaaaattagcagatgatgtattggccatcactgtgataggtgctgcctgggtaaatgcagtgataaatgcaagtgaaccgccaagataccggcaggctgtgcatcgtctgttcatagttttattgctcctctcagattagtggaatggattattttctcatactttatcattagaatgtgtttattttgtgatggggtggactttttttaagggcagaagggcgggggtggttccgtccgtgagtggaatggggatgggggctgcggatacggctgcgggactagtggctctaaggctgaggaaaacggcgctggacaagaggctggctgccgaactcgcgcttaggtatcaccagccatctggatgttgggctcagacaagggcgccagcctcttagcaccgtttccctcagcctaagacccacacgtccctgtagatgcatccacagcccccatccccattccactcacccgctacgtttttccttcgcttctgcatcgcttaaatctgcgtcggggaattgtgccgcaaacccagggggatcctttagtgaaatgacatgtgcattaaaggtgtggtatgatttgacgtaatgacagtttctttatatgttgtacatagaaaaaaaggggggatatggatacttagaactgacagactttgccaatacccaaaaatctatcctacttccagagcgggtgttttttcgtacgtcatggctggaattaccagtccggggagcgggccagggcggggcttgtgtctgggggtgggcggcggcggggaggccttcgggcattggcggtccgggcgcatagtggaggagggtgcagcttcttaggtcctggcagtataaaagatgggggtggacgaatgcatcaaagcataagtccaaggtgctctgagctgagaaagtccttcaggatttctcagcgaatagcaccggtcccccatcttttatactgtcagggccttagaagctgcccctccggaacttggcgtccggaccgccaatgcccgaaggcctccccggcaccgcccgcccccgggcacaaggcccaccctggcccgttccccggacgtcccccatgaaaaaaaacacccgctcctctcacatcaacggagcaaccaaccgcatcaggcgccccagtttcttgccgccccagctataatccctgcaattctccatagtaatccggctgcatttgcgcagggtatcctgataatccttttccacatccagtaccacagggttccggtatatatatgtggcgcattcaaaatgcagatacaggcttctgaaatccaggttaatggtccctaccaccgccttctcatcatcgctgacaaataccttggcgtgtacgaaccccggcgtatattcgtatatcttcacccctgcctcaatcagttcaggataataggtccttgccagaagatacgcatacttcttatccgggatatggggcatgatgatggtcacgtcaatgccgcgcttcgcagcatagcagagcgcattttccatctcgtcatccagtatcaggtaaggcgtcatgatatggacgtaattcttggcctggttcaggatatccagatagaccctctccccaacctgttcacggtccatggggctgtccccatagggaaggacgaatccgcctgtctccccttcgcccgtttctgcagcgcctctgggcagtacatagcggccaaagtcatcctgttccctctccgtcacgttccacatctgcaggaacatcatggtgaaactgttgaccgcgtcccctttaagcatcacggccgtatccttccaatggccgaacctcaccttcctgttaatgtactcatccgccaggttcaccccgcctgtgaatgcggtctggccgtcaatcacgacaatcttgcggtggtcacggttattctggtaggtggacagggtcggcctgatgggtgagaacatcttgcacctgattcccttgccctccagtaccctgggataccggtacggcagcagcatcaggcagcacatcccgtcatacatgacgcggacctccacgccttcctttaccttttcttccaggatttccaggatactgtcccacatatatccccgctccacaataaaatactccatgaagatgaaatgcctggcagccctcagctcccgcttcagggcctcgaatttatcctctcccagaggaaaatactccacggaggtattttcatatacaggatatcccgcataatccttcatataatcaatcagatggctgctcctctggctggacctcctgattttctcctgtaccgccatgtcctgattcagatagggcgccgtggactttatggtactcctgagacgcctggccagaagcttggtctgaaactgcatctggacaaagatataaagcagcaccccgaataccgggattaccagtaccggtacgatccacgccatcttaaagctggaattgataggttcattgaaaatatatatgatgacgcctgcgctgagcaggatggataccgcatatatgatatggacataatcctccagccatctgaacaccccaaacaggatacccagctgtatggccatgaacaggattacaaatgccgtccgcccaaatatgatcctgaataatccccgcagttttttcatcatccactcactcctcttatgtcttttccgattttcctattatctcatgacttggcctgttttgcaagccgtccgccctatgcggggaaatgcggtcccttatactaccgaacattatttccaaatctgtctcattcagcagccgcagcttcacggacccggcttctgcggatcataagccttttcataccggtagcggattccattcccaacctgttcctgaaaaatataaaggcgctgcggcctggccggaattacccggtcatcgccgctgcgcctttcccaaatatcctttggtctaaatcagctattgttacgtgactcagccgctccctgcagcaacggtccaaatcaccatataattcatccatcactccggccatgcctgaggcaatcatgcagctcatatgaggatccccgcttttccatgacactgtcacaaacggggtgtcaagggcctccgccaccatggacagggttatctcccggctgtcccggtggaacaggtatccgccgtccacgccctcctttgtcttcactaagtcagcctttttaagctttgccatgactttgcggattctcgctgcattggtacagacgttttctgccaatccctcactggaatatacctgggccttatggttgagaaaaaccaatgcatggactgcaattgtaaattcgcttgtcactttatcactactcccctttcacatcaaaacatctggtacatctttgtaaataataccattaattccagaaaaatgcactggttttttccatattccagagaatattttatcattccccactgcccggtccggccaggttaaggtccggcactccctgggccggcatgctctggattacaatctcctggctttccgctggaagcccggtcccgtcctgagtctcatttccctgggtcacggcgccctggtctgcgttctcctgtcctgatgtctcctcagggggcactgcggcggaattccgctgtatctttgcagcctttgccttatacgtgctggtgtgcagcgctgtctcttccagcagctcaccattcttctttatctggcggtatgtcttccacacagagcctggctgtgcctgttcgattatccgctcctccccgtaagccagttcaggattctcctcatataacggctccggcggctccaggtctttaaccttctctgagcgcatggatatggtttttccgtcctccagtaccggcagtcccacgattgacagtttcagtttgttatctgcaaacgctgccctcagtccgatggatgtgctgcctgtattgacaaaccgaaggtccgggcctgcgtagccatcaaagctgaccatggcatcctgccccttttcaatatagctgggggcaaagctgtggaaattgcgttccgtggtcttaaaacccgactggatgattgcatggtacagggtggtggaaacctggcatacgcctccgcccggctcctcaatcagcaccccgttccggtacgcgcccgctggctggtatcccttatcactggtacggttcccggttgccatgttaaatgaaaactcctcacccggttttagcacaagcccgtcaatggcgtccgctgccaggcggatgttctggttcctgttcttattgctggtggtggtggtggaaaatgtgcctatgaccttatactgctcctttgcctgggcctttgtccttaccggggcaaccgacaggaatgacgcctgtactgtcgcatcgggccgggcattctcctgcccgtttccttcttcctgtcctctgccctgtgcattttcctgcttccatgccctgactgcctggaacagttcctctgccagcctgccttcatccagcgcccgcccatacacctcatctgaataaaggtaagtgcctgtatccttatcaaatgcttccatctgggaatctaccggatcccggttccattttgcagcaatccgggaagcttctttttccagggattcccttataagcgcatcatccttttcctgataccatctggccggaatctcaatcatttccgtatcattaacatccactacccggatactccactcctgtgggccctgttcctgttccatgccgtccccggcactgctgttcctgtcatcggccaggctccttgctgcaacggaaccggaggacggcatcttcacacttacctgtgcattctctgccgtcttctcctttcccgtcctcaattccacgattccgtatattacagcggcagctgccagcgctgacaataaccaagtcttgcgccacatatgtcttattcttttgttacggttccttctgcccctgcctcttttcatgtctttaactccgctttccttccattgtctgtttgattatgcttttcatcatatcttcactcagctgtccgctggcatatccgaatacatttccatccttgtcaatcatgaacgtggtcggataggaaaatacaccgtagttcatgaagatatcgcctgtggtatccatcagcacagggtaggtatatccgtgttcattcaggaaatccttaatcccttcctcagagcgctcgcttcccattcccggagcggcgattcccagtaccaccagagcgtcatccccttctgtttcataggtttcatataatttctgtatatccggcatctcagcgcggcacggcggacaccaggttgcccagaagttaaggaacactgtctttcctttgtaatccgacagggtgtggatattcccatactggtccgtcagggtgaaatcaatggccggaagcgtctgctcatctgcggcgccgtcagatgccgtttcattatcctgtccggctccctggttttccgccgccgtcccgtcctggcctgtccctgtatcgtcagaggacctctctgctgaacctgcatctgcagcgctggtggcagcttctgcttcctgcatgctttcatctgcagcgccggtaccagcttctgcttcctgcatgccttcgtccgcagcacccttttcccgggaatcatcaccgccattgccgccggctgttttatcagctgatgtgctaaaaggcgcctggaatgtggaaaggtatccggtcacggcattcatcctgcctgtgaacatcagaagtcccatgatcagcatcaggacgcctcccgccttaaccgtgtacttcaccacattcacatgtgtcttaaagaactccagaagcgtggtcgtgaacagacccactgccaggaacggaaggacgaaaccgatggtatacacaccaatcagtccaaaagccattgccttggtgcttgcagaggctgccatcagcagcacgctggccagggccggacccacgcatggcgtccatgcgaagctgaaggtaaatcccatgagcagggccgtgaacggcgacattgccagggcatccagcttaaacggcagcctccgctccctgcccaacacctgggaggttccgaaaaatcccagctggtacagtccgaagagcaccaccaggatgccgccgatcctggcaaacatcagctggttgcttttaaagaagcttcccatggctgaaaagccgaatcccagcaggaaaaacgcaaagcttacgccaatcacaaaacacagggtgtggagcatgacttttttccgctcatagtggatgcgtccgtcctccccgcgttttccggtgccgcctgacagatacccgatatacaggggtaaaagcggaagcacgcatggtgagaagaaactgaccaggccctgaaggaatacggtcaggacaggtacgcttatatctaatgaaaatcccataaagtaatctccttatatatgaatgttaaactgcaaataaatcgttgaatgcctcgctcatggtcggatgtgtatagatggtatcccgcaggacggtgtagggtacctttgcatccatggccagcttaatcatattgataagctcataggactcttcacagaacagatgggcccccaggatcaatcctgtctcctcatcaatcactgcctttaaaagtccggccggctgttccaggacctgggccttggggatggccgccgctgccagctttgccacctttaccttgtaccctgcttccaatgcctccttctcactcatgcccacccttgaaaatggaggatccaggaacacactgtagggcaccgcgcccctcttcttcaaatcgtagcttccatctcccaggacactggatttcacaatcctgaaatcatccagggaaatgtatgtaaactggagtccgcccctcacatcgcccatcgcgtatatatgaggcgccgtggtcctaagtgaatcatcggtaatgatgccgcccctggcattgacctcaacgcccgcggctttgagattcaggtcctttgtgtttggcctgcgccctgtggccaccagcactgcgtccgcttccagttccaccaggccgtccctgccctccaggtccacgattgcctttcctccgccctggcgcacggcctttgtcctgactccggtcagtacacggatacctcttgcctccagtgactttttcacttcccctgcaatctcagcatcttcccttggcaggaaaatatccccatcctgaagtatggtcacttcggagccaaaacttgcataaatggaggaaaattctactccaatatatccgccgcctatgataaccagtttttcaggcagttccctgcggcttagaagcccttcactcgtatagacataagggttatccttcaggccttcaatgggcggtacaaaggcgctggaaccggtattgatgaaaatcatcttcccttctacctcataccgttccccgccgttcaccacctccaccacatggggtgatacaaaaccggctgtgccatccaggaccgtgatattcggattgctgtccagcttgtcataattcttttgcctaagctttgctgtcaggctgtccttctgcgccatggcttccctgtatgcatctgccttatctttaaaatcccctcctcttgccagggcaaggccggcgcgatataccagtgacttggtaggaatacatcccacgttaatacatgtgccgccgtacatcatggaagaacgttcaatcagcgcaaccttcctgcctgccgccccaagggctcctgccatggtcttgccgcctttgccaaatcctattataactgcatcatactgattcattctctccatcattctttttctcctttatagtgtaatcgtatttgttacagttcttactgtaactatacatgatacagttatctttgtcaaggatattatttaaaaaatcaaaatgcatctgccggacagaaaaagcctggggaatatcccccagactttccacttgtgcaggtcataccgcttccatccatcatggttcttctatctggaccggaaccaggtattcctgtttccagtcatacatcgccccgcttatctccagttccaccatggactctccttcacggcagctcacttcataacccttaagccctgcgcttcccgtatttcccccgtccgttccagccccttcataaaccggccttgccattacggagcctgggtatgacgccgggttttctaccgccctgtgcatgttaagccttataaacttcctggaactgtccttcatccttacctccgcccccacgaacacaaaaggcccttcctcatctgctccccagacattcccaaggaccggctcctccgacttcctggcgctggtaaatttcaccgtacatcctcccagctcaatcacggcatccatatctgaacccccgtcccttatgggaactgacaggcgctccggctccccggtataaatcatattgacagagtcaaacccaagccatatccttccacccctggccgatggcgccaggtcgtaggaaacagtctgcccctgctttccctcaggtatcccgcttatgtaatcccatgagtcattggcgctgtgtccactgtccctcagccgtccttttccttccatgtccccattctcataactgagtcccgaaataacgggatacatgatataaccttgttccgggtacgtataataggttatgtccaggccatcgtccgcccattgcccttttgccaggattcccatcccttcctggaatacaatccccggtatatcttctaccgccggatactccctggctttcacgaacgcgaaagataatgtctgctcaaatcccggtacatgaagttcatacgtcccctcaggagtcaacgtatcaaggacttgattttccgtgaaataatcccagtacatggttatgtatccttctgtcccataagtcccgtatacaatggaaccggtgcgtttggtggccgtgatcctgcctcccgggattccggcgccttcaatatagtctgtcatggattccgttgtccggtcatagaagccatgccccagcccggtccggtccaggaatccgctcctgccgtacaccccgccctcataatccaggacaaaataaggcttcttccattttaccggtctgccctcttcctgaagcttacggttctcatcttcctctttaagaagtacctttacctcatcatccggtatgaccgtgactgaataatcctccaccttcacacggtaataccatttaccatcctggtaggtcacggactcaagccatgccttggctccctgcgtgcttatgggctgctgtcccggctccgcataataaacaggaggctttccaggcgcgcagataccatgtccctctacaaactggactccgcttacatgcattggttccaaagaatccgccccatctgcttccggctggccttcaccggctttagcatggccttcatcagcttgggcctggccttccttgttctccgtacctgaaaccataccctcttcagatgcagtcccggccatctgtccggaaggactgcctccccgggcattccccatatccgtcccttgtccgcagccgcctaaaaacactgccagcagtatgattccagccacaaggaacctcctccatccatgctgattgctgtccgtatgccggggacatgcccatccatatctcaatctgcacctgttttcaaacatatatccaatatcctgcctcatggccttcctcctttcctgcagccttccccatctgtattatcaatggcccttactgtcctgtttgaccgacatactgttttatcaatggtccttactgccctgtttgaccgacatactgttttatcaatgatccttactgccctgcttgaccgacatactgtaaatcactgcgcctgtcaccacgatgacaagcacaatcatccctcccacaaccgcaggcagcggtaccttatcctgtcctgtcctgggaagcccggccaggtcagaccggttcatggccggaaccagctttgggggttgtatccccattgctttgggatgttcctccccgggattgctgatattcacccagaagtccttatatccgtaataataggcggagtgtccccacagatttccgtcctcatcctcatatgtcttatcaaattccatcttcccttccagggaatccaccttgccgtaccattccccggagccgggatactcccagagataaatcacaccattatccggaatggacacctgaggcatatcctcttcacctgtttttttaatcccagcctgatgttcctctgcaaagctcagtccatcgtaaaccgccacaaggctgtccatatcaatccagccgaccgtggcgtcatcaccccagctgtagtcctccacaggccggccgtctccgtccatcttatattggaccagtccccaggtatccgtgatacccctgccataagacatggacacatagaatatttccccattggaaatgtagtccagcacgttccggcttccaggctccttcaccacagacacgtatcccttaggaccattggcataataccggcgtcccacataatcacaggcattgtaattcttttcataaaatgaatcctccggcgtccagatcacatccgcccatgcagttgcggcgtacatcccgcacaggcagaatgccaggatagccgcgcgtatggcagttctcccaaaaattacagcccgcatcattcctttccttctttttccatccatcacaatatacctccctaatttagtcaagtcatcttatatcagcatggccagtatggttcccatcataaaagaaaacaggttggccccggccgagaacagccatggatgccttatgccgcgtccggctgcccgatagcacaggccttccgccgcaaccgccgccatctccaggagtaccgtgaccagaatccggttccagcccgcatatattatatttacatgatataaaaacaccaccgccgggttcgtcaggacattcacaagtccaaccagcgccatatcccatctgttcctgactcccagcatccagccaaacgtcccttccagcacaacggtaagccccagggacactgccagtgccggaatcatccaggctcccatcattccctcacctgccttatcccccatgtcaaaagcaccatggacaggatggccatcacagccataccaaccggggaggcagccgcctcagcagctcctccggtccgtattccggctcccgccagatatacggggcagaatcccagaaacagcccaaaggtcaggagaccgaacccaaacccctttgcgcctgggaacatcctggaaaccgcccacagggtaaggggcatggacatattccagcagaataccccaaggattcccgtcaagggatacatcaggcagatgaatccggccgctgccgcgcacatggaacgctgcgcggcctgcgccaccccaatgcggtctgcaaggaacccgcctgccattttacccaggaccaccgcacagaccaggaaccaggtgcttccggccagctcctccttccatgggaagtcctgtaccattccggaataagaacgcagtatgaccactcccaggaagcatatcactgccgccagccggggaaaggtcagattcccataggaaaccggcccattgcccgaccgcctccatatcccctgccttcctgccatggcatggatggccgcggcagacacagccagcgccaatgccaggacaatgcccacccacatggttctgcccgtaagcccgtttcctcccctgccaatgctgcttcccagtgcaatccccagtgcccccggggccacgaatactcccagcaatgccgccctgtccccgctgcggttcagcacatcgatgccgcctcccacatggaaacatgcatttccggctcctgcaatgacacatgccatggcaggcatcccggccatggccatgaccaggccgcagagcacgcccccgcagccgcctgcggcaaccaggctgttccggtccagccggtcagcccaggccccgatgggcatctgcaaggcaaatgcacagaaattgtaggccagcagccagatataccagtgttcccctcccgccacaaaggcgtacatcaggaaggcgcaggataaatccactgccatatgtgccagcgcatagattccggtcatgattcccctccgttttcatattcttatcttcattctaccacggcaggaaaaaggatactttacgtttttcctaatatttccctacaggttatggcccagggtgtgtttgaaaattgctttccgtcagctgtacggcccaggcccccttacagccgcaaagcagcctcaagggccaaagccatatacttatccgcgctttccaatccgtaatccgtcaggtcccggggctgccatacatcgttatccaggcagtcggcgccatagaaaaactgtgcaaatctgacccccctgaaacgggcggcagccagaagcgcggaatactccatatcagtaccgatgcagcctgcctccctgcgttccctcacaaggtcctgcgtctccctgtatatggcatcattggtccacatctttcccaacacaacagggcagccgcacctcatcaggcagtcctttaacagcgcggtcgtcccttcatccgcctcaatctccgcgctgggaggaagatagtggtagctggtgccctcgtccctcacggctccggtgggaacaatcaggctttttccaaccttctcctcattaaggatgccgcaggagccaaaaaacacgaatttcctggctcccattgcgattacctcctccaggccgcagacacaggcaggcgcacctaccagcgaaagataaagcccaaactccctgcccccatatgtaatcctatacaccgggttggccccattggcggtatataatactgctatggcctccgtctgctccattgccgcataacgctggatgattgtcctggaaaatgtagacacacacgtctccgggaaaccgggaaccggctttattaaatcggatggatggatcattgcccgtgaatccccaagcccatccggttgtgcactgtttctgtaaaatacggttttcatcttatatttcctccttcttcccatgtgccccaatcagcatttccttaatctgccctgtaatcctccgggggattgccctgtcaaccggcatcagtctgctgtacatccttaccccctggtatgaaaagacaatcacatcaaatacagcctccggttccactgccctgaattccccagtcccaatcccatattcaatcagccccacccacatctttttagaagcaaggtattgctgcatgatggaatggctgcatcctgccgccgggggattgctgaaaaactcatagatggcaaggctcagggaactgccgctgtccatcatctcttcttcataccggcaaaggacttcctccaatatcattgccgcaggtaccttggcctgcatctttcctgcaaattcatcctcctggcttgccataagatacgtgatgatttcctggaaaatctgtcccgtactttcataatgacggtacaggccgcccctgctaagcccggtttccatacagatatcctgcatcgtcacatccttatatcccttttttgcaaacagcccgtaggcggcccggcatataagctgctttgttttctctcccttgattcccatctttttcctcacatatccatgattcattctttttttgcgacatcaatgtctctttatattatgcgacatcaatgtcgcaatgtcaagcacttatattaccatctaaaaaacgtaaaccagcatacaggctatccattaccattctttttaagtccaaaatgtaaggttgacattactaaaataaatgtctatactagagtaaggttaacattacagaaaggagcatatcattgaaaaacagaattaaggaactgcgggaagaaagaggattgacgcaggaacagttaggccagatggttggtacatcaaggcaggcaatcaacgccatagaaacagaaaaattcgaaccgtccatatggcttgcttatgatatatcacaggtgttcaactgttccatcgaggaagtgtttttatttgaggatagtacgcgcaaaacaagggctgacagcagcaggagggataacaatggcgataagaaacatccggtatgacaatgatccgattctgaggaaaagatgtaaggaagttaaaacggtggacgataaaatcagactgcttcttgatgatatggcagaaaccctgcatcatactgaaaacggggctgcattggcagccaatcaagtcggaatcttaaaacgcctggttgtgatagattactgtgattaccatctcaaattagtaaatccacaaatcatagggtatagcggcgttcaggaatgcattgaaggatgtcttagtttcccaaaccgctttgtgaaaacaatccgtccgcaaaaagtcacaatccaatcgctggatgaaaatggtaaagagattatcattacgggagaaaatgaaatggcaaaatgcttttgtcatgagttagaacatttagatggaatcatttttttagataaagccatagaagaggtaagactggaaccatgatccaggtaagacattaacatacacggaacgacaggatgggatgcgggaaccgattaaggggatactgcgtcttttacgcggaaccaaaacaggggggctaaagctaattccagccgccggcatacgtcactgccggtacggctg
